United States Patent 11,180,807 (METHODS FOR DETECTING A GENETIC VARIATION IN ATTRACTIN-LIKE 1 (ATRNL1) GENE IN SUBJECT WITH PARKINSON'S DISEASE) - sequence listing, part 33

SEQ ID NO: 406 - DNA, 1101578 bp, Homo sapiens
  misc_feature (686218)..(786217): n is a, c, g, or t
cgcagtcagagctgcctctcgccctcgctagctgggctcgcagcctcttcctccctccctggctcctggctttttgtttaaagcaacacccaccctccatccaggctttttttctttctttctttattggtagcggccaaaaagagttgattgctattgggatccgctgagtaaagacacgggcaggggtgcgcggaggtgagaaaactgaagacctggaagatttttttttccttcaaaaacccgtttccatccagtcttcagccagtccagtctactttaatcctcaccaggacaatggattaagtttctcttccctggaccagaagtcgggttcggacttggggcaaaatgaaggaaaaggccatgatcaagaccgctaagatgcaggggaacgtgatggtgagtgccacggacagggcgcgcgctgggtcggggggacccaccgtgaggagcgatgctgggggaggtctgtccttctcagtcccgaacctccctggaaggacagcgaccccatgcccgcgcgcggcggcgcttctcccacttcccacccgagcccacccagcggcagggggatgcggaggagcaggcatttctttgcaaattgcaactttgcggctccgcggcccctctccttcgggcatgtggctttgtgttttgggcgcgggatgggaggaaggggctgcggggagccctcgctgaccgcgggtcggtccgagccccaagcagacccccagggctcttctggggaaacgcggggagaggtggtcacttcggccagggaagggccactgggccctggcgcccgcgccggcctcggtgctccgagtccccggaactcgagacctgttgggtctgcggagccttcggtgctctcggggcaggcgccagtcgctccgctccgttccagacgccgccgccgggcgggaccctgctccctggattggggacgctgactcccccaaaagcttgactgtgccggaggaggtcaggggcacttcgtcccccaggagggccgcgtgcctggaaacgcggctggtccgcggaaggctccgggcagctggccaggggacagttctgcacggataactttctaagtggaggacccggcgatccgcctccccagcgagcccacccgcctcgccgctccccgctgacccgcgcggcctgggcgcgcctgctctcgggctcacgttagtccggggcacggggccgaggggtcagggcgctggagtctctggcgaggacgagagagttgccatcttgttctgttgaaattgtttgtgtgccttcgtgtgtttattttaacccattaggtcatggtctgagaagaatcctctgacggtcccttattttaagttgctggctggcactttttttttttttttttttttttttggcgacagacaaggagatggggattgccttgctacttttgaaggttctgcagatttgcagatgctacttttgagggttccgtaagaattgaagaaattctttcaggggcaaggtccagagttgtttacagaagtgggttgggtccaagtgatgggggtgcagaggcacctttgcgggaacccaggcagtggtgcattttgagatctcgctttaagcaaaacaggcaataagtgaaaaattctacattaattgaacaaatacccagctggcttaaccacacccacggcagacacctgttgcctggcagagagaagcgccgtgggttcagaacttgactctggacggaggtgtgagtctctgggttcaagacacctcgcagggaagtaatcgccgcatggaggggcttactcttcaggaccctccccactcccgagacgacaagcccccatctaggggcggttcgcagtcctcggtccgtgggttctctgactgacctaattgcttgtttatgaaaatgcatctgcttccctcatttttcccactctttttcttttttagccattgtgttgttcagcataatttcttgcataaacaggatagaaacgtgtatggagtaatgctttttcattaaatgcccaaccacatccatcattcctaacttacgtgatgccatcatgtgctagggaaacctgtatatttagggctgaggctgaagttaaggattgaggttaattatactgataaggcaacattattgactcattacatcaatctaccgccaaataagtttctacttataacttgcatggcatgaaagagccaaatcttcatattacacctttattagaaaccttatggtctttgccctccccctaacccctctctgcgttttacttcagaaaataaagaatgaaaggattgctaattacatttctctcttctgctctgaataaggatattccatgtgatactcattgcatcccttcccctgtgtctaatgttaagaagtgtcatcggagcaaggtgaacctgagcctagagaattctacagcaacccatattttcagagttatttgtgggcccaagaaaacaatgagatgcacacttactcaaactttgaatgttcttatcaattcttgaattgataattatggctccacagcctgctgtgtaacttatttgaattttcatgttccaaggaaatccacgtggcttcagttgagtgatcatttaggacttacccatgcctaatctctcaagttgctttggaagactcttgctaatcacagcctctcttggattagatgactggcaaattctttgcactcacaacttgattgaaattcaggtgatattttacattcaagatgaggactgaatgatttactcctattactgacagctgagctgccgcacatctgacagctacaaaaagtggcagaatgttttctactttgcagtaacagtgaacccacatacacacagagaccagatctcagttcaggggactcaaagatctctgagctgtctggactcgcatttgaggtttgatatttaaaaaagagaaagacactttgcactgcccaaatggtcacggaaatgtcaaatccagttcagccatgcctgtaaactgctttctaatccagcccctgctcgctgacatccacattgtatgattgttctggacctgcagcctgttgtttcaccgggagttctacaagaatggtgacaatagcctcccggctggtccttgccatgccacattgcttagttgaaagtatgttcttataaaatctttaaaaaatgttttattcctcacatattgctttaggaatttatttctgagtacagctagaggattaagagaaggcagatgcaccagcatactatctgatcttgttttgttttagtaaatgggtaaaagaaataccacaggtggaatcagtttagaacttttttttttttttttttttttttttggagacagagtctcactctgtcacccaggctggagtgcagtgcagtagcgcaatctcagttcactcctcccccagggttcaagccattctcctgcctcagcctctcgagtagctggggactacaggcgtgcaccaccatgcctggcttttttttttttttgcatttttagtagagacggggtttcatcatgttggccaggctggtcttgaacccctgacctcaggtaatctgcctgtctcggcctcccaaagtgctgggattacaggtgtgagccaccatgactggccagtttagaacttctattttaatttttttttttttttttttttgagatggagtctcactctgtcacccaggctggagtgcagtggtgctatctcggctcactgcaagctccgcctcccgggttcatgccattctcctgcctcagcctccccagtagctaggactacaggcgcccaccaccatgcccggctaatttttttgtatttttcgtagagacggggtttcgccatgttagccaggatggtctcgatctcttgacctcatgatccacccgcctcggcctcccaaagtgctgggattacaggcgtgagccaccttgcctggcccctagaacttctattttaattcttgagaagagtctatttcataaacttataatactgtgagaattcacagactaaccatgccatattcaatctgtaatttaatatactaagagataaatattttttacttgctcgaaacaaaaattatttttttaaaaatagctgttattttttccataaaatctacatttcagagttccaagggaggctgatgtgcactttttcaacctaatcttcctttattgctgtttggttgatattctgcttgtttaacagaggtatatactcttgcaataggttctgaggttaatgggaaatgtcatcagaagggtgttgcttcgtgctgaattcccctactctgtccatatgagcttttttcagacattgagttgcttaatgaagttggagtaaagattaaagactaaacatcttggggactgtcctgtgacccttggcgtctcccccttccttggtgtgtgcattggtggctccaccagtatgtggtgggtaagtgagggctgtgcaggcccatggtgactacagcagtatcagaggaggttcagacctaggacacaaagcatcagaggtctgcaagccatgttgatccttgagaatcccactgttgattgttgttggttttaaatgaaagtggctgtcttgagttccctgtatagggaaagctggagttcttccttgtgctcactgacactggttttaggcctttggtcactggttgatgtatctatggcatgacgagcctaggatcttttcagaactattgtcttctcttttctatgttggataaaacatctgaatgtgaactttccacagtaagagttctctttcgggcatttgaccgttttgctgattcagttaaataaagcagaatggcattccagcgatgatgctgtacttgtaattagcccaggtgagcagaggctcgttgaggtttttagataagtcatgagagctcgtgtgggacacaaagcttctattatttttttttttctgagatggagtctcactctgtctcccaggctggaatgcagtggcacagtctcagctcactgcagccttcacctcccaggttcaagcaatcctcttacctcagcctcccaagtagctaggattacaggcatgtgccaccacacccagttaatttttgtatttttagtagagacgaggttttgccacgttggtcaggctggtctcaaactcctgacgtcaggtggtctgcccgtctcggccccccaaagtgctgtgagccacctctccctgccaaatcttctattattgaagtctgtggggacagcatttctaggagtgtggccttcagtaatgcaatatttttcctctgtctgagggtacttggtatcagattggtcacttggtaacaaaatgcttggtgctggttctaaatgggagcagtgtagcacagattttgagggaatttgccttctcaaaatgggttccaaaaattctaaggtcacagttttctgagagttgtcaccatgtgtcccagtggtgtgatacttaggttggtctttctctgcttgctagttgttcaacatcccttcataaaatcatcacccttataactagacgtttcttgaaatattgattaatcccatctgtgcaggaaacagtagctaggcatgggtctgtttcataatcctccttgcaggatttataggaatggggatactttaaacatgtttatggcccattaaaaaatgcagatttccagaaagaagatcccaaagccagaggtgatcagcacaggatgttttataaaatttcttcaataaaactgtagtgaagagggctgtgctgttttttcacagagctctgtttagttctttagttcatatatccactgggtctgagtttttcaacatataaatgtactaaattggctcttccctgttgcacagccatcatctccttttctgtaacctgtcctggtcagtaatcacaatactgctaacttgatcatcatttggactttgaaccctctgtgctattaccaagaggtgtggtgcttattgaaatatgaacatctagtattcattcgtccccatggacaagggctttgcacaggaagcatttgagcggatgaattcgttaaatgaatggatatttgttccttgcttaggactgcttagcataggctgtgcatttgtgagaaaggctcatggttttagttgaacgtttaagaactccttcaagtcctaatacatcaggtaacaggagagagaattccctgcatagagtattttccactttcagctacaaatggaaacttaggctcagtttagattgtaaacagctgatgcatcaatcttctttatttgaggaggcgtagaagtcaaataaaatatagagagcaatctctcaacttaaaatgttttacttgggaagcaagaattgcaatctgaggcatacacagaccagtggtcttcagtatgtctgaagaacaaagacgagattgtggattttattaggaaaggaaatgttacttactgttttggaagaaaactcattggccctggagaagcttttgagagctggcaagctctgattggtgagttgactgtggtaggtaaagctagagtcactgcaggttgtttcagcagttactaggtaaaactggtcttagaggtacagcaggctgtttcagcagctgagcttgtgggaaatttaattcttggagcaggtgctatgtgtccccagtactttttccctggccccgcaactcacacattgagttgcttaatgaaaatggagtaaagactacagactaaacttcttggggactgccctgtgacccttggtttccaaggaccacaaggattttattgggtatgacaagaatgacccaatttgtataatcagcttttgcagaggtaaatacatttagtccagatcattttaaaattttctgtttattaaactaaaataaattcagcaacatagaagaattccatgacctcttttggttgtgggagccaattttatttgatagcaagaccacattttagaactcaagagcgtgcctcagatcttctaggtcccttgaacatactaagctcagaacagacaggcaggcagaaccaagcagaattccccctttaccattgtggcttcctgggatgatgggagaaagggttccattcgggaagtagaagtttcaaaaacccatcttggacagtggctcttggcaatggctgaacagtagaatcagctggaatgttttgaaaaacccagtcatctatgggtgttgtggagttgggaatgtttggttaagtgtagaggttctcaacattgcctggagccactggttcctcctgcccccgacctcttccccagtacccacccctggcctagagatacccaggggattctgattccactgcttcaaaatgcagtctgtgcactcatatgtttaatagtgcttctgttgtgcagccaagatgcagaaccagtggatcagaggcaaattttttgaataaatattgccatcaaagcctaaggaaataattataacatttataagggagcttcttgaaaaatatgcaatcaagtcttgttccctgggttgtggaggccgccaaatacatggaaagatgggcagagaacacagaataaggagaaaaatgaagtgaaacatgcatgagagagaaaagtaaatagtcaccagggaaaagatgaggaaacatgctgtgtttttaagttttctaacctcagttatagactgaatttggggaaaaacaagaatctttaaagaaattcaattgtcctcctttcctttttcttcacgcccagaaaaaattaatcttcttgactgaaagatactctattatgtgtctgaggtccccccgaaaagttattacaaacccaacagggcaagtagaaacaaggagggtgatagaagaaagctgaaggctgccctcgaccagcagaagttgttctgggatttgcaatggcctctgaggggcctctgcaggcagctccctggactgctgtttcctcatgtgtcgaataaggaaatttgaatagattgattattcttgaagtccctttcaactccctctcccagttaagggtagcctcattactgtctcctcaacattgctcttaggacatgctttagaagtcaccttccatgccagaacaaatattttgttggcatcatgatttcttctgcattgacttatgtggcatctctcagctcgccagtcttgtctcagcaagcatgccactgtatacggggaaaacaaatagatggcatcaatgtatagtcctattggacacaaaatctagagcattcatgcaccagccttgatgacccaggaagactgtatatgtgtgtgtgtagcacaccatatacatgcatgtgcatgcgtgcacacacacacacacacacacacacacacacacacaatgttcatacatctcagatgtaaaatactggcaccattgtccagcatagctgaagatctgttggataagagctcctgtgggtgcaatcactttgactgcttggctttcttggatattaaaaaaataaccacactgtaataaaacaggagtgccaaggatgttctggtttccagtgtggtgttactcgtctgtgaaaataaaagtgaattgctggctagccaggccggccacaaggcctgttttgcaaggcaccaattggatgggatgggactgcactgggtctcactacgagaggtctaaggctgagcacattttcttcactgatattggtatttgaaaagtgggattttcttctctttttccctctcctactggactaatgcccctattaagccacacatagttttattttaaataattctcattttatggtattggtcctatataaacaacttttagtaaaacctccactgacagaaactcaactacaaacttgagcaaactggactaacagtctcatacgtttcattacattaatctaaaaaatggtacttctagggtatgttctgacttcattatacattcagcttaatattctataccttcttgtcctatatttttgggaagtgagaattaataattttcaagcctaaaggccaaatttttttttcattcttataaaaattattttgattgtggactacattttctatgatgaggtaaaaatgaattaacacatgaacaatttatctttaacaggctgggcacagtggctcacacctgtaatctcagcactttgggaggctgaggtgggaggatcacttgaggccaggaatttgataccagcctgtgcaacatagacagcatctctacaaaaaaatttttaaaaataattatccagaagttgatattatattatgtggctgtcatcctagctactgaggaggctgaggcaggaggatcttttgagcccatgagattgaggctgccgtgggccaagattgtgccaatgcacttcagcctgggtggcaaagcaagaccccgtttctttaaaaagtaatacataaataaatatacttatttataacagaaaatcaaagattatcttgttaaatggtagttttctagaaaattgcatttatcagaccaaatcatatcttgagcaaactttttataagagggttctgttttgttatttttcttcctatgactctgtaaattgtgcatctatttttttaagatctccaccctttcatttcaaacttaattatattgataacttatagttgtagagaacttacacagcttccaaaataattttgtctgtgctatgttattatgttagaacaacccattgtgttggaaagacagatattagttctttttttatggttgaaagagctaagattttgagagagtatatagtggggctggttatttgaggaggagctgaggtgctgacccatttccagcccaggttctttgcacaccacaatgtattctttcagaaattatcttctttccagttgcaactgaaaagaaacatagtgcctggaagatgggggagaaaaataagagatcaagtgggagagtatgtcttctgctctatcctcataggatttctagcctctgctggaacacatccaaggactggaaacttgtgccattgttgacaagttctgtttgttaaaatggtatttcttaagttcggaagatacatatacatacctccattgaactttcacctacagttttagcttgaagccttttaactacaaaaattttcttatccctacttcacatgacaacctttcaagtaagttccaacagttgccatgtgaccccttcatagtctcttttctagggaaaatgtctctatttctttcaacttatatatgaaagtttgatcagggtaactgtgaatttaacaacaagacaccatattttttattcaatcattgccatcgttatctgtttcttagcttccacaaatttcttcctatttattgttgttgatttgatagtcttcatactgttttccacagtggctgtactaatttaattcccaccagcagtgcacaagtgttcccctttctccacatcctcaccaataaatgctacttgtttttgagccattagtgaactgatagaaaacagcattctggaccgaaaaagtagattgtctccaaaagctgtgtggataaggagcaatgaaagaaagataataccaaggcaaatacctggaggatgtgaagccaagagcatcagaggagaaaaggaaccatcaagaggttggttagtgggtacaaacagacagatagaaggaataagttctcatgttcaatagcacagtagggtgactgcaattactaataatttattgtatatttcaaaacagctaaaagagtctgggtgcagtggctcacacctgtaatctcagcactttgggaggtcgaggtgggagaattacttgagtctaggagtttaagaccagcctgggccacacaacaagacgccatctctaaaaaaaatttaaaatatgccaggcttggtggcatccacctgtagtcccagctacttgggaggcttaggtgcaaggattgcttgaggccaggagttcaaggttaaagtgagctgtgatggtgccacggcactccagcctgggtgacagagtgagaccttgtctgtaaaaaaataataataattagaagagaagatttgaaatgttcccaacgtgaaaaaatgatcactgtttgaggtgatgaatatcctaagtaaacatacatcaaaatatcacatgtacctcataaatatgtataattattatgtatcaacaagaaaatgaaaacgagaatgttgaaacaggtggaaagatattcatatagagcctttgggaaatgctagtcactggacatgggaggaaaatggccgtcttcagttgcggtatcagaggccttccacaataagcagtgttaattggcaaacaggggctatgagaaacacacaagtgatgaaaaccagccttatttctactggaatctcaggtcttacctgacttaccaccatctaagtttgcatagtcacctctaaaagtgtgagcatcttttctgtgctttgctggtttgtatataacttttattcagatatctttcactctaataagtagttctttgcattctgattagttggctttatgaaataagtcaccattattcaagaagggaaaggcgagagacaaaggcattcggcttccattagtgtttggaattacagccacacacaaattaagggtgaatgaaaacaaatgccctcctgtagctgctgctggtattcctccccacctcctcttcactctctctcctcctcctcctttttctccttctcttatttatcctcctcctcttcttccttctcctcttcctcttccttctcctcctcctcctcctccttctcctcctcctcctttgattatcttaagccagatgtgtattcttacccaggtttgtgatatgtctacccttgcctttatgttgggaaacgtgaggaagctgagcccagctcccaggacagtttggtcgcctctaatcataccatccagccataatctcaggctgaaggaaatcattcattggcactaaagagagctggggagatagctgacagaggaatgcaatggatcgtctcgctcatccaccttttgccatttgtttgattttttcctgcaatgtgttttcttctcgtcaacttggccggaatggtggtaaatgctgtttttatatgtggacttacttgaaaaactgatctatcttagtcttggactttgaatatcattaaagttctccaaggaccttgcaaatagctgcttgccaaacacaatagtttaatataatttgatctctcactgctgcttagcttctgagaaatgtgttgtgctcaaagtgttcaagcattaattaaaattgagagcactgaaattgtcagcgcccactgactccatgtgagtgtgtaggtgagtgtgaatgtgtgtgcacaggcaggtgcaggtgtgtactcacatgcgtattaacgcttaggaagctgaactttgcttctttctcattaagagttgaaggctattatctaatcatgaaaataaaaactctgatggaattaacttgatgttgactctcagtttgatttctgaagataaaccagagtcatctctactctgaaatattaacgtattctagagagtggttcccaacatgatgtgacgctggacctgcgttatcagcatcagctgggagctttagaagaacaaaatcttgagcccacccagacctactgaatcagaagctcagagggtgggtgattctgatctgcattaaaatttagttctaagtgtacccattcgcaaactctttgtggtgaagtgccagtgatttcatttttgtttttaaaatttcgtggctcagtactttctcccatctttctgttttttttttttttctgagccctacaaactttttcaacctctgccctaaagctgctttcagattttcaggtatctttgtagcaatgccccattccttggtatgtgttgctataaaggcatacctgaggctgggtaatctttaaggaaaagaggtttattttgctcacggttctgcaagctgtacaagaagcacaggcaccagcatctgcttctggtgaagtcctcaagctgtttccactcatggcagaaggtggaggggagccagtgtgtagaaatcacatggccatagagggaacaagagagagaggaaggaggtgccaagctctttttaacaatcagttacccagggaatgagtaacgggatgactaactcattatctcgagggtaacaccaagccattcatgaggcgtctgcctccatgacccaaatacctctcagtagattccacctccacctccaaccttggggatcaaatttgaacatgaggtttggggggtggataaacatccaaactatagcagcacccaaaagctgaaagtgccatgtcttattttttattttcagccttatccgtagcacgctttatggtagcaaagaggtctacaagctgtggccccaaaataatttaactttcttactgtaacctttccattttaaatttgattcactgtagagcatttccatgggtagaactgggtcaaagagaagtctttcattttagagttttgttattaaggaagaattgggtattttcatactttttaaagtttatttttggctatgattacttacagtggttcattttttatagacatctaggaaatgttaattactgcagataagattcccaattcagaagccaaccacaaaggcttttcttcttcttcttctatatatatataaaggagataatgctaaaatgctcttatgcaaattttaaaattccctagtacattaacaatgctaatgacagttaatgcattcctgaagcttctgtgtgatccaaaatattcaaaatgcttagaaatgttttaggtccaccctgcaaatatatgggaagtggaattttgttcatggaaattagttccttgaaaatagattcagtgccaagtttaagagatgaagaagagctgaaaagtcagtgtagtgcaatatagagtcttctgcggataaaggtcgaaaccctcttttcccagaccaccatagtgggtaggtacagaatctcagataatcactgcagtttggttagaagaggaaattgcccttcataaagcaacacagaagaaggtaaggagaaagtggtattagattgataggtcaactaatgataatgaagaaactttctcttgctgacggtgatgtcagcttctaccaggactaacttcagtgagcacaggaatggcattgctgttcaatagggttataccctcaggtgggatgacagaagacagaccctcgttgtttctttgctgacctagggaattctgcaaagcagaaatatgaagaatgaagatgctgactctttacagacagctttatttaggtgaattcaggttgttacatggtcttgccacaagtgcatcttattctagaagttgtctgactacttcaacatgcatttctttccttctttcttccttgagctccttaatattaaatgcaaatgaggggaggcgtgttgaagttacactaaggtttagttgtagcaaaaatgtgctttgtgcacctactggaaattcccttgtggaatctttatagtaaagcctattggggaaatataattgaaaacaaaatcttcttccaacctagaaatcctctccacaaaggtagtagagaaagagaacacttttcttatttgaataagcattaaaccagaatggtgatgcacatcacagacaagatgctaaaagatcacaaagacagaattctcttatatagccaggcagatgcaacccattaaatacatgttttcaagataaacagtagctcaccctgaagtaagaggatttgacagcatcatttgtcaaatagttcatcctaactttactagctgcttactggctttatttagaggggggaaaagcctctcatatcttcatgatagaaggtagttttgcatattagagcaaagtgtccaccgatgttaggctccagaaactgggagacaggggttctgtctcccttgatgtttgcattttaaaaagatggttccagatctttgggaacaagatccccgggtcataaagctaacaaaagccctccctatctagtcttcacaaggatgcacttccaagagatgaaaaagtgcttataggccgggcgtggtggctcacacctgtaatcccagcactttgggaggctgaggcgggtggatcacctgaggtcaggagttcgagaccagcctggccaacatggtgaaaccctgtctctactaaaaatacaaaaaattagctgggtgtggtggcaggtgcctgtaatcccagctgtttgggaggttgaggcaggagtatcgcttgaacctgggaaggggaggttgcagtgagccgagcttacaccattgcactccagcctgggtaacaagagtgaaaccccgtcaaaaaaaaaagtgcttataattacaagttttcttaggtaaagctctaagaaaaaggagaagaaaacactttcctcctgattttcaacaggaagaagtaagtgtcttatttctagcttgtattagtccttacaagccagagcattcaaatgagtaaccgctacaatagccagcaaagctacagacacccagtaagaggaactggagcctgtcccaggcttgcagatgctgagtgctcgagatgttgacacaatttagccaaaattgaggatcaggagactgccaaggacaccggtgcttgatggaactattccctcttccaagaatttaagagcaagaaaaaaactcagccatatacttggagcagtggctttcatattcaggactaggagcatttgggttctgcaggatgtgggatggaggcatggctaaggagcagccataggggtgatcggagtggccacaggggtgatcaggcctgaaaagcctgccactcagaagcctttcttccaagagttgtttattcactgcttagcaatgagatcagcactttgcctgctgcatctcacaaagccctctgacaaccctggatgaaggtactaatatctttagttttcaaatgaggctcaaagaagttcaatgagaaaactgcccagggtcacctaggtagtaggtagaaaattagtatcccacttagatgtgtgtcactgtgtcatctgaagagaagagattaagcattgggcttgctagacaacaaggatactcttcaacatataaacaatcttattcaataaaatcttattaatgccctgttgactgaggttgcattaagagcatgtggaagcttatccgatgtttccattctctggtctctacttgtgactttgctttttattttctcttctgtgctggaagtgctggaaagcacctcatcttttgtcttttcagttgttggatttaggttccatgattaagggttgtgttgctattgttttcagtactttgttctctttctgtatcccaggaagtcagcaactgggccctgtctcctacagaagcaggaagaggactgagggttgagggacttttggtggttttctaaaactgtcaatcatcctatgtgtgacaagcagagagtttcctgtatctctgttgcctaagcaaaggagcaggtgggaaagtattttgctaactagcgatctaagatgaggtttttgttgttgttgttgtcatttttgagatggactctcactgtgttgcctaagctggacggcagtggcatgatcttgactcactgcagcttccacctcccaagctcaagcaattctcctgcctcagcctcccaagtagctgggactacaggcacgcaccactatgcctggctaatttttgtattcttagtaaagacggggtttcactgtgttggccaggctggtctcgaactcctgagctcaagtgatatgcccgcctcagcctcccaaaatgctgggattacaggcgtgagtcaccacacctggccagttattctttgattctcctgcaccatctttcaattttttacacttggggcattttccctgttctcagcaccctcatcagtgtggaccaggacaacgggagagggtaaacctgaattcctccaactctaatgactttattaaaaggcttgagggggagggcagaaagggtatagtggtaacagtgagcactttgaatctcacttaccctaatcatttcttgaatgattgaaggagtaatgggaccctccttattccttactcctaaattctcactattgattgaacgtctcatacgcaggcactgagacacctcagtgaataaaatatagtcctcgccttccttcttggggcttccattctagtggcagaaatagacagtgattacacagctaattatttaattacaagtctgatgcattctgcaaaaacattgtaagggccaagggaaagcttctcctttgccttctgaaggttcactgaaaatcaactgatgaaagacaggtgaacaggagaagaggcttacaaatttgatcacagttttacacaggagctttcggaatgaagacgcaaagatagacaggaagctgtccatttttatgcttaggttcaacaaactgtggacagctgtgtggaaataggattggcacaaagggtctgatctaatgccaatacagtgagggggaaagcccagtaagatctgcccatctagattcttcttggcctctctgcagaattccttccttctgggcatggggcagcaccctctctgtaatgggaggtcttatgacccacagtcgaacaaggcaggtcaggtgatttcgttatggtcagtttttacacagaaaggtggggaaagttggagtagtagttttaggttttatggctggcttttgggaacagaggatctggttcgtatgattatgttgggagagaggatcctagtttctctggccagcctcgggagaaaatgaggggccagaaacagaagagcaggagggggagtggggagaaatgtttgcttctgaggccttcattttgggttatcattttctgggcctcagcaaaagcagattgagattattattatattaacataagcattgtggtctaggtttggatgtttctacaaggtgtttcgaagcgaatgactcagtgaaagatacaatgggtgagaaagatggttctctcacattgtcaatccaaggcagaataaaaaagtcataattaaaaatatttcttaaaggggataaaatgagtatgtattggcaatttgctactacagtgaggtgtttaaaaagagaaaaaaaattaaatgaaatgtaaaatgaaacctgggtatctataacttgtgaaggctgaggaatagaagatacttcactgagaaaaggcagaggactcccttgactaggtgtaaggatgtgctcttgagatgctgggaacaaggaagtccgtgggagcaatggggaggaccaacacacgagcagcatctgctttgaaaagtggagactgaattgcggtttgatcctgggagcaaacaccaaagaacttagagctaataatagcgaagccataggaagagcagcaacagagaagcttgggtggaaggacttcgaatacataaaagttggaacaaaataaaccaaggagacaaacggaagtgttacacaggtatttttctttataagagaaatatattttaagagcactaaagggcctttgagctcagcttttatgaagaaatctgtttcaagatagaagagatatattgtaggtttctgttaaattaatggcaaataccactagctaagacaaagctagtgcttaagagctaagcattctttattttaattagtttattcttatggatttaggggtacaagtgcagttgtgttacgcggatatagtgtgtggtggtgaagtctgggctttttgtgtgctcatcgctcatagactgtacattgtacccactgggtagtatgtgacaccccacactcctcccaccctccaatctttggaatctacagtgtctattattgcactctatacgttgctgtgtatccattgtttaactcccagttataagtgaggatgtgtggcttttaagtttttaatttctgagttagggtctcactctgtctcccaggctggggtgcacttgcatgatcttggctcgctgcagcctcggcctcccaggctcaggtaatcctcccacctcagcctcctgagtagctgggaccacaggcacatcttaccatgtctagttaatttttgtatttttttgtagagacagggtttctccatgttgcccaggctggtctcaaactctcagactcaagcaatccacccgcttcaggcagctagggtgtgaggattacaggcgtgagccattgctcccaaccccagtttttaactttttgttgtcgagcaatttcactaaggataatagcctccatttctacccctcctggaaaagacaagttttcattctttcatatggccgagtagtattccatcgtgtatacgtaccacattttaaaaatccagtcatccattaatagacgcttagattgcttctgtgactttgctgttgtgaatagtgctgcaataaacatgtaagtcagatgtctttttgataaaataagttattttcctttgcatagatacccagtagtgttattggtagatcaaagtgtagttccatttttagttctttgagaaatttccatactgtttcccatagaggttgtattaatttacatttctaccaatagtatataaccattcccttttctctgcatccttgccaacatctgttgtttttttgactttcaaataatggctttctgagtgctgtaagatggtatctcattgtggctttaatttgcacttctctgatgatgagtgatgatgagcattttttcctgtgtttgttggccaagagctaagcattctgatggcttcgtgtggatcaaatcacagctggattgttcagttttggatgccaaatataaagagggacagacaaactggcattcatccagaagagaggaatcaggatcacgagagattagaagttgtattggtaaagggaatttgaataaatgatattatctaatctaggtgtgatagctaaatttatgtgtccacttggctgggctgcagtgcccaggtacgttgtgagacatcattctggatatttccatgagggtgttttggatgagatgaacatttaaatcagtggactttgagtaaagcagattgccttccctggtgcagtgggccttgtccaatcagttggaggtctggatagaacaagaggctgacctccccagagtaatggggaattctgcagcaaatggcctctggacttgaactgcagcattgacttttctctgggtttccagcctgctggtctgtccacattttggacttgccagctcctataatcacatgagctcattccttagtataaatctttctatatacgtatgtgtacgtcctattccttctgtttctcctgggaacgctgactgatacactaggaaagcagagatgtgggatggaggcatggtaagtgtttttagatatctggagggcttttatggaaatagacacagatttgttttctatgaatttgagagacccagatccctggattgaaatttagaggctggaagttttttttttttttttttttgcttaattgaaagaagacaacaagaattgatacattgatacaattcttttttagctgattgtgagtcagcaaaattcaaaacattgagttctttatagcttccgtgcatcaccacttgtgcaaggtactgtagaatggattcaatgtgcctgttgggaattagaattataaagaattttggaagtttctagtctgtcattgtttctggtaatgcatgctgtgaagggctaagaaatgtgttcatcccacagaggatgaaacaacagacttggtcaaaaaagtatagttatggtccttttaaatggaaaaattcagaccacagctggataggaacaaaatcctgaaaacagtgacagattcagtgtctggttattttaatactactcatgtgtagacatggatagaaaaatgcagatagtagagtaccaaaaaatacctattggaagtataaaaagaatggtaattaaatgatttctataggcacacagtctgataagagagagacctcattttatgtagctcttttactgaaaatgtggcatttatttttctgtattaattcaatgtatttcaaatgaactaaaaacctgccatcttcaaggatttcattatacgattccttatgaacactgtcataaaatgagtagttaactcatttaattttttgtgaatgaaaatatgaatggtcacatgttgaatttatttttatttttttacttttttgagacagagtcttgctctgtcgcccaggctggagtcagtggtgcaatcttggctcactgcaacctccgcctcccagattcaagcgattctcctgcctcagcctcctgagtacctgggactacaggcacgtgccaccatgccgggctaatttttgtatttttagtagagatggggtttcactatattggccaggccggtctcgaactcctaacctcatgatctgcccgcctcagccttccaaagtgctgggattacaggcatgagccactgtgctcagccctaaatttactttaaaagggttatacatgtgttggtaaatagcatcaagaaatacattccttctatgttatcgttattttaattctttatttttgtccccaaaagatttacttacagatcttggatgatcttgggtcttgaatgggcatgctgaggttctacctctgggcaggaagataggtgtgaagcaacctctaacagcttgtgcggaaaattacccccaggttagcaccagtgaggcacagttgttcagcagagcaggggctgggcattgttgtagagcagagccacgcccttccattccagagcacttggagcagttggtgtttatgctgctgggttgtttttattgaggacaaacatgcttttacatttatctatcttaaaaaaaacttaaaaactcacaagacaacttccctgatatgccctgtccccctccagctaccagtctttcccttgaataactcaatactataatgccactatttttaactcctcctcatttcctcttaaaaatctcccatctgactttggttcttaccactgcatggaagaattacctgtccacatcgcaaacgacctccttcccactatattcagtggtcagttcccacttaagtctctgaaggagctcaggaaatgacaccccaaaatacaccgctttggacttcaaacttccccagtcacttggtgaacagcaaattctgagaggagctttctgagtaccttttacctaccagacggatcctccagaggggacacaattgtcatgaatcccctccctagaacttcatcaaccagggactgctggctgatatcacaggagaggatattggagctgacactgcacccagacaggttttgtctcaggctgtcttctgtcctgctaaggggccattcacccgccctagaaatcatttactctcccctaagttgcctacatccaccctctctctcctatggagagggtatataagctttcggatgtctctgggtttcgagtattcatttttctttcatgtgatgctccgtgaatgtaatacacatgtatactttttctcttgttaatctgtcttaagtcaatttaatttgtagcccagccaaggaacttccaagagtggaaggaggccattttcacccttccagggcctggcagcacttttttgaccactttctttctttctttttttttttttgagatggagtctcgctctgtcacacaggctggagtgcagtggtgcaatctcggctcactgcaacctctgcctcctgcgttcaagcacttctcctgcctcagacccctgagtagctgggactataggcacgagcccacacccagataattttgaccactttctttattgagcttccaggtcacccttccctccatctcaggggctgcttatttccttttcctggctgcctctccagcccagggctcaagcatcattcttctgccttttcctagatggcctcattcatctacatagctttaagcagaatctgtgttctgaagacttctaaatttgcatgtcagcctctgagctttaggcttttacaccaaatttcccccagacttcacctctcacgtgcctaatgggtcataaaaaccagcagagccaaaacagaactggatttacctcttccacccctttctccctgggcttcctgaccttggtgcacagaaccattgttcatcctaatattcaggctctgaagcttgcagcgacctttggtttcgttctcacttcatagctcacagccaatccccacatcaacaagcagctcgggtttcagatgcatcacatctgaccacgtctcccctccctcaggggtcccagttcagtcagtgccatcatcctctcctacctggactgcaagtggactcttacttggcttccctgcttccactttgggtcagagacacatcatgtgtcctcagagacaaattatgagtccagagtgatcgttttagacacgggtcagattacttcactcactagctctgcactctgctaggataaaaccatatttcttactgagacactggctggctgatgtagaggcctccagcctgacccctagccttgctggggtctcaggggcacattgagtcttattgagtcccagctcctttgcacctgcttctccttccctgaaaccgtcttcacccagatgttggcttgctctttgcagagtgctcttcctgtagaccttcatgctcaaatcgttgtccacactctgtgccccttccccagtatcatgatccctgctcagtcactcgctgtccacaccctttcctttcactgagatcatagtgtatgtttattggttggcatgactattatctgtctccacagctaggatgtaggcttcactctcagggatcttgtcttgtcttgttcactttttgtatccctagtagatgctctcccaaatttagatggaatgaattaatgtgggggaggagttgttcagaatgtgatttaatacataaaaaacttttggctccccactcccttcctctctcagtttgcaatggaaagtgattgcaaagtaaagatagtacagattggtaatttggtaatcactgtgtcagtgtggctcacagtggcaacattatcacatgcagattaataaattgaggtcaacagaaactgcttctgcatgcagagaatataggaggacagagaggacagagatacatatagtgttatattactatcaccaattcagttacaatgctgttaggttttgtcacctatttttaaataattgtcctgttacatctttttctttttgcggaaggcaccagtttagcatagtttgtgcaatggctgtccattaaaatcttagtaaggtgataatccaaatcagatgctgtatagcctatgctggtttaagtcctgaagtacttatctgaaaacttcgggttaaattaggaattcagaacttttcagaattcaagaagctaacacaaattgtctttattatgtattaggtaacatccccagtggtgtctgaggcaccatcccacaaacccattgtaatttctgccaaaaaaaaatatgtacactaagtagaatcaataaatttaccagtggcttcatatcagttcctgtaatttttgccactgaagaagttcagagaagaaaagattttgtctccaaatgagtttttaaggagctttattggatgaaattactgaaacattgaaacatatacacactcaaataaaacgaactggaaccgtcgcaaaggatgcagaggaggtggcctgacatcagctgagaggggaggtcagagagaacccagggagcgagagcttcatgaaagagatgcagctggagttgcactttagttgaaggactcctctgcaaaaagctgaatcctccccagcctggatccaaattctctttcctattacatttcagctgccaaaatagctctttgaatttggtgcttagaaggatttagagatactaaaaattgcagcatttcctacagagctatttgtaagaggaaagcaatggaggtagagaagtgggttgttgagaataatagggtgaacttgaaagaggaaaagatgaggattaaaataggggcaatcttcctcatgttgaaatttctgaaattcagtattctctaaggagttgcactctaatttttcttaagggggagaaaatgaaagttttcaaatcatacacgtgcacagacacacacacctatgttttgcagggaggaatagctgagctgttagagccccacacagcaggtaatctctttggcctcctcattaacactctaatcagcccttttgcagccattctaacttaagaaaaatagtaaacctctgaaatagccttaaaaaagatgagtgtaaaccacttcagtctagcttttgaacatggtgtctattgaaaaccctattatgttagctggtaaccaacgatggaggtttcttctccagtagtaactgtgtgtaaaggtttttatgcttaggactgtgtttaggagttgtgatacattttatttagttttgagatggaatctcactctgtcgcccagactggagtgcggtggcacgatctcaactcactgcaacctctgcctcccaggttcaagcaattctcatgcctcagcctcctaagtagccgggattacaggcaagcaccaccatgctcagctaatttttgtacttttagtagagacagggtatcaccatgtcagccagcaggtctcaaactcctgacctcaagtcatcacccaccatgacctcccaaagtgctgggattacaggcgtgagccactgcacccggccaacatatcaattatttggtttgagctagcttacaataaaatcactcttacaacagagattcattgtttcttcatgtttctgtaagctgcatttaagtatcataaagtctaaaaattggataaaaatatgatgactgaccttaatttctacctccctgggacttggttctagagctgtagtttggaccagcactaagtctgtcttaccttttttcccctgataaatattcagtatttgaggaaatcatcacatctccctttagcattcttttggcaaggtaaaagactactgaatccagttttggggaccattgttaaactttgctttttcagaccttagaaacatgttaaagtcttgcaaaggagcccttggcataactgtgtgactagatatgctccaaagctctagaacatgatgatgttccatgtacgtctccatctgagtaagggggggaagagggcttggctggtgctggatgggtctcattcaatgcaatgccaaactcttaacatttgaaaattatatagtagaaatacggactttcttatgaatgccaagaaactgcttgcttctcctattgtctgaatagccagagagaatacttgcacttactattcactgaaaactgacttatttggtgataacggtttggctgtatccccacccaaatctcatcttgaattgtagctcccataattcccacgtgttgtgggagggacctggcaggaggtaattgaatcatgggggtgggtctttcccatgctgttctcgtcatactgaataagtcccacaaggtctgatgattttataagggcagagtttccctgcacaagttctgtcttccctgccaccatggaagacgtgccttttgccttctgccatgattgtgagccctccccagccatgtggaactgtgagttcataaaacctctttttctgtataattaccccagtcttaaatatgtctttttcagtagcatgagaacagactaatacatatggctaagtcagatcctaagtccaggaattccccagttctccataccttccctggagctgtatgtttataagaattttctcttcagtaggagcccttttaaattgcagaagtgctttcttctgaccacagccctatctttgagggaatagctttattgagttattgtttgcatagcatatttaagagtacagttcaataaattttagcatatttagagttgtgctaccatcaccacaatctaattttataacattcactgcatttggaaaggaaacttcatctcatctcatgagtttattttgaatgtggatcttcttggaaaagtaactgattcctcttctttacagataaagacatcagcgttcggagagattgagactgcctttgttctttattccacagggcccagagtgcatcacccaagaaagctctctgaccatgcatggtcaagtataaaacagtgtacgaatgttaaactagtgttagatgatttttgtctatgctgtggggctcacctctcccatctctcccagtctcatccataactgggtctgaactcttgcttttatttattatttaaaatttcaaactatcttgtccttgtctagctaaaattgctaatgccctttttaagctttccttaaagggatttaattgttcagcagtagaatcttttctgctgtacgtgtgatttctcttggaggaagtgaattctttcttataagtgagtgtcaaggggaaagcacagaacatcaggcttaaagcttgagttgtggccctatgatttcagttccatatacagaaatccatccgcccaacaaagaaccttctaaacattctacagacttgtccaaagtgactctactgtgtagcagagcagagaaaccaagtttgtgacccattttctggcatcctaaaggatatctaagaacctagtgatgacacccccagtccctagctcctacccccatgccaagctgtctcccactcattgcctctggatcatggtgcaacttgccactccaagaagatccacatgcaaataagctcatgaaatggaacgaggtttcctagggccatgtcctactcacatttgaatgaccatagttttagcaagatcatctttttaagaatagtttgcttctttctaacaccgaagtgaaattggtagaaacagagagaatcaggatcagaattaaagagacgagatagctctggaggcctttgaggacagtcactcccatgtgaagtgaaaacaaaccaagggtagcagtggcccctaccactgggggcagagatgctggttgctagaatggcaccaggggtacagaaagtcaccttctgctcctgtgacttgcttatcccatgctgcatgggtgtgaaaggttctgatgctactctttgtatttttggtagagagacaatgaatcagcatttcaagctacaggcaaaataaataatatgtttagacatgtcttaaaggattaatacttcagaatctgagaaagcaaagttagtaaacccaacctgggccagtggtggacacactaagataaatagctcctctgatttttatttatttatttatttatttatttatttatttattttcgagacagagtctcgctctgtcgcccaggctggagtgcagtggcgcgatctctgctcactgcaagctctgcctcccaggttcacgccattctcctgcctcagcctcccgagtagctgggactacaggcgcccgccactgcgcctggctaatgtttttttttttgtatttttagtagagatggggtttcaccatgttagccaggatagtctcgatctcctgacctcttgatcctcccaccttggcctcacaaagtgctgggattacaggcgtgagccactgtgcccggccctctgatttttaaataacatgttcttggagaaagtggggcctgaacagtcagtcacattttcttcccctatctccccttccctcctgtcccctcctatctcctcccctctcctcccctcccctctcctcccctcctctctcctcccctcccctcccctcttcgaagtctatctctgtcacccagactggagtgcagtggcacgatctcggctcactgcaacctctgcctcccaggttcaagcaattctgcctcagcctcccgagtaggtaggattacaggtgcccaccatcacgcccagctaatttttgtatttttagtagaaacggggtttcactgtgttggctaggctggtctcgaactcctgacctcatgatctgcccgcctcggcctcccaaagtgctgggattacaagcgtgagctactgcacccggccttcttttttatttttacatatccttaaggactaggaaacatttgggtcacactggtgcttacattcaaacctataaacaggaattaatgtatttctttgccatttattttataaattttattactctgtgtgtgtattttaaagaagaatttctggtgagttttctattcttatttgtatctattacttacctcaatggcttgttccaacatgattgttgtgtgtaaaagtaatttgtgaatagagcatcgctgattagtgttgtcacaattgagcgagtgtgtcccagagctttgcttttcacactcgcacactcatatggatcatctgaaaatcttgtgaaaatgtagattccattcagtgggtctggggtgggacctgggattctgcatttctaacaaactccagagagatgtggatgctgcatctgtgagctgtgctttaagtagcaagttcttatagggtctacagtgtgatgaaccagacagggccaagcaatgcaggtttccccagagatgagcacttcctgcccctcagtctgtagggattaggacacagtgcctatcacagttggcttgtgggaatatattctgggagcagaggcctgcttggagaacaaatgtcctctttgctacgtttttccagcatttaaattgatccagtatgggactgtacagatagcaagaaatgcagatgaacttgggcagtgttaaaacctggatatcctccatgaagcagattgggtctggcccatgctggtggcagtttacctcctcccgctgttccctcttccctggccactgagggtttataaacttgtgaaggcgtggagactctcaggaagttgctgccacatttctctctcttacagacgctaagattccctttcagtaattgaaagtggtctgaaggctctggaaagacagaaatgaaggaccttctttaaaaacaaacgtttacagcaccttctcgaagattcaaatttcgtggattatatgtggttattctagtgtgacatgcgaagggtggataggtacctgtttttaaaaggtatttttgttttgacatttcgtatttccattatttcaaattgcatcagactgaagtcctagcaaaagtatacattacttttatctttccattcatgggaaaatgaaagaaaatgtttcagagacttttctaaaaagatttgatctcctcagtgttaatatccttagctacccaattcagaaaattacagatttccttataattggtttacttgattatttaggatgttttctgtcatcctgggggatgtagaatgtgtgtctgatacagtgattgttagttttaaacaaataagaacatgctatatgtgacacatgcacacctcgtgagctgaactggtactttaactaccacatggcacatttattcccaaagctattgggtcagataccattttctggaaataaccgagtcataaatgatggcgtcttattggtctctacaacatgaccctaggacactttgactgctgtgaaactggcacttaaaatagagtgaaatataattgaaaattgcacattgaagatttcttattcattccttattattagctgcagaaatcatgtgtttatagacctttttcagttggatatcttttgctattttaaaatgattgaatacgttagtcagtttgactatttctgccaaggcaaaaagaagagttaattaaaacacacacacacacacacacacacacacacacacacacactctctctctctctctctctctctttttctgccaaggcaaaaagaagaggtaattaaaacacacacacacacacacacacacacacacacacacacacagtctctctctctctctctctctctctctctctctctctctctctctctctctctgtctctctcactactggtgatatcatctctgtgtagccaagcagaccactacagatcattgcttttcttagaaattacagccgggcatggtggctcaagcctgtaatcccagcactttgagaggcccacctgggcagatcacttgaggccaggagttcaggatcaacctggccaacatggtgaaaccccgtctctactaaaatacaaaaattagctgggcatggtggtgcatgcctgtaattccagctacttgggaggctgaggcatgagaattgcttgaacctgggaggcagaggttgcagtgagccgagatcatgccactgcactccagtctgggtgacagagcaagactctgtctcaaaaaaaaaaaaaaaaaaagaaaatttgagtaataaaatcagaactatcctgtgtgcctcggtacagtggagtaagaatgtctgttcctcatgctgtaccccattcaaaacagttgaatgcatggcttgagaatgggttgtaaaccacagctggatttccttggccttattcttgaactgtttgtaattggtgagaaagcagtgagcccagcagatggagaatttgctacctgaggacactcggtgtcatccaggtgctaggtgatctgactctatgtcatccttgcaccagtggaagattgggttatgcctttcccctagcaaactctcatgcagcctcctggggcaccagtgcattcatcgtccgaatgcctggctggggacaagaccagagggcctgaaggaaagctggttccaggaggaacccaggctcattcttggcctcatgcatgtgagtccttaaacaccagtttgcacatattcagtgctacactaaactctacctctgcctaagttgaatggttgtctactttgatgaaaaaaaatgtgtttaatagaggacttcctcatgtaggaaagcagaaatggtaatttacagaggataagaaaaagtacacgttaatccaagaaatacaaactcaggtggatgaactgcagaggccaggagtcagggggaaataagaattagccccaataggtctgttttataagcacagagaacaacatgcatgtaatattgtgtcaaatacttctaaaaaatgaaagcttcggcctctgtttcatgaatttctccgttaaattattcagtctgatttatgagctactgtttaatgtattttagattggggaaatcaaataggagtggggtggatgtaattgtatttattacaaatgtgagttgcttgttcattgagattattataaagttggccagagaatggattgacttttcaggtcctagacacacctgcccaggaagtaacgtcactaatagtaatagtacctggaggtagcatgagcttattgatttagttttacttctgcctgaggccaaaatgtcctgcagtagtaatgattcaaatgtacctcatggaaatcaagtgaggtaatgcaaagaacatgaaatccacatacttgctgctgttgacagaaaactgttccatgccaggcaggatctagccaacaggctgttgtagattgctgataattagcttccctgaaagtcgagggggtgacctgcagacatgtcactgggttaataatttctgtttttgtttttataacttcccttgaagcaaagttctttcctgtgtccgggtcttcccagaattggctgagagaaccgacaagcaactggcttgctatccaaagtgctaaagaatcttttgcgatgctgtgtggcaacaatgttgcaatcattaatagaactgatctaaaaggaagaaagagagaaagacaagaggcctcaaagcagcgagaaaggttgctggaggtactgttccagaatgggttgtagaactcccagctggtggacccttcacttacttcctgtgtaggtagtcaacctttttcttttatctctctctttttttttttttttttgagatggagtctcactctgtcccaggctggagtgcagtggcgggatctcggctcactgcaacctccgcctcctgggttcaagctgttctcctaccttagcctcctgagtagctgggattacaaacgtgtgccaccatgcctggctaatttttgtatttttagcagagatggggtttcaccatgttggccaggctggtctcgaactcctgacctcatgatctgcccacctcagcctcccaaagtgctgggattacaggcgtgagccaccgcgcctggccctttcttacacgttattaatattaatacaaatgtgtcaccaatttcactatcatcatgcaccaaataagtcacttcctagattaaaatactaagtctcagaaggcttaaataagggcatctacccacacgatcctgaagttctgtgggaggttgtatttatctttcacaattattgaattccttgctctatagcgagaagatctggccacatgactttccctggccaatgatatgtaggagaaagcgagtgttaggagccacttgtggctgtgtctctctttttctgctgttagatcagcatgtattttaggtacaggctgtgctgtcagcctggatcccagagggaagaagacacagagcagggtacccttggtggatgctcggcaagagccgggagcaagcctctcctcctcaggcctctagggttctggaattgattgttatcacagcataactcagcccagcctgactgataacagacatcttaagtattaggatcttcagtttatatttatttaaaatgatgttatcttgtcacattgttccaaaaactattaaatgctgcttacaaaatacatccaattcagtggaattaaaatgaataaagcacataactcataacatttttgagtaaaagaaaatgagggtagagaaatcaatcaaggccaaggctgacaccgtttgatccagtaaagtgtgtgacgtgtctgcccaaggccagccacagtgccactgtaaagagggaacacattgttcacagcctaaatatacctgactgttttcatctccagcaagctctgcacacagtgagtaatagcagagtgagaattaaagtgtgctactttatcagtagctgaacaggtacataatggccctttaaataaaatgctggattaggacacatcacttaggtctccagacttagtagagtgtcttaccttccgctgtttcttctcaacccccaagtctaaattttgattcaagcaaacttgaaagtatctgcaaggcgagaaagttagctgggtctgaggagcaggctctggccaagctgacacacccagctgtgcattttggagagtgctgcaaagcaaagtctcaccagggcctgcctctctgcctactgcatgggaacaggaagcctatcagagccgacggctttgcacgtcaggcccagcaacccaagggcactattgatctggttcaaccgatacggtcctgagtgggagtctagaggtaaggacacggtgtgtagagtcagtgatgatgactcgatggcaaggtagaaacacttcccacgctcatacaaactgtaaacccaagtgggtgtacttttctttgtttaaaataaaaagaataattggctgggtgaggtggctgatgcctgtaatcctagcactttgggaggctgaggcaggcagattgcttgagtccaggagtctgagaccaggctgggcaacatagtgagaccccgtctctataaaaaattcagattagctgggcatagtggcatgcttttgtattcccagctgcttgggaggctaaggtaggaggatcacctgagcctgggaggtcaaggctgcagtgagccgtggtagcaccactgtactccagcctgggtgacagagtgagaccttgtctctaaaaacaagatgaagcaaaatgataatctcagccacctgtcaccagcttaactgcatttctccaggtctgagaaacaaattctatacatatttttatgtctctgatatcattgtatatcttataaataatggtataccatattttaattgggagtaatttttctttataaagtggtccataaaacagtgttacatattacaatcaataatctcttagatttgatgaaatgtggtaaaagaacatttaccatggcaaaaataccaccttgcatcaggagagaaagggttctatcctgaatagcccacgctgggtttaaggagaggccttagcgagcccccagcactctgacgtgtctgacatccagtctttggacaacaatcaaaaaagggacatccaaagctggcccatttcagaaaaggcaacgcagacacctgcagtccctgacatcagtgattccaaatgggttgggactctttgatcatttttaataaacccaaagtttgcagctcaaaatggccagagccacgtagtgagtgatttgcagaagcaaatgcaatgcttggaccttcaatccccagaaagcaaggatggaatggtgaaaccagctgccgccaaacagccaggcagtgggcgtcctagcgggaaagaggaatagaaggatttgagattaagcaggcactgaacacctaggagaccatccttagaatcccagtctctttatgttgaaaattattgcctgttagaaagacctgtttcctaaggcaaagggcaaggtgaacataacatccatggcattaagatgcctaatgccaggtttattatggtatgtgtatgtgcacgtattttctatcctgcatgctaagtatttgaagtggaacttgcagacaaccatgtggagtgatggattaaatttcccctttcttaggaagttcagaagtccaaggaggcagtgttcatgaatagaaggttccttcatcttggcccggcgtggtggctcatgcctgtagtcccagcactttgggaggccaaggcgggcagatcatgaggtcaggagatcgagaccatcctggctaatatggtgaaacctcgtctctactaaaaatacaaaaaattagccgggcatggtggcgggcacctgtagtcccagctacttgggaggctgaggcagaagaatggcgtgaacccaggaggcacagcttgcagtgagctgagatcgtgccactgcactccagcctgggcaacagagcgagactccatctcaaaaaaaaaaaaaaaaaaaaaagaagattccttcatcttagcggggaggatctgaaggagtcaccctggttacatctttgtatctcaccctcacaatgctcatttagtcatcggtggatccctttaaatatcaagtatgggatacaaaaggataatactagaaaataaatactaactcagccatgctatggtttaaatatcaccaggcacacaagactcaagaactgcttttcaaatccatgaacatacgtgtctacagtcattttctagctgggtaaccctgagctggttatgcagtctctctgttagtttccttatatgtgtaacataaaataacagtaatgtgtattattgaggatttttttttttttttcgagacggagtcttgctctgtcaccaggctggagtgcaatggcgcgatccctgtgatctccgcctcctgagttcaagcgattctcctgcctcagcctcccgagtagctgggattataggcacatgtcaccacgctcaactaattttttgtattttagtagagacgaggtttcaccattttggccaggatggtctcgatctcctgaccttgtgatctgcctgcctcagcctccccaaagtgctgggattacaggcgtgagccactgtgcccggcctcattgagggttttgaggaggtttaaatgaattgatattggtgtttgatgatgatgacaatgatgatgaaagttgttattaaaccatcgctccctccctgtggccagccttcccaccttctgggagatcttattcaatcttttaactctccccttttctagagctttccttctgctttctggatcacagcactgggaatgtggatctgcttttagatcagtgctttgagaagtaggagaacaactgtggtcgtggcggttggtctttgatgccagtaagcaacagaccatctgccttgttgttgatctgagtcattgatggccagattgaaagagcagagggttcctgagtcccaggtgttgcaggacgttgtgtgtgcccacaagccaggctacatggcttagagcagcagcccaagtgctccgttggttcagggggtagcaggggtccatggagaagtcagagtcctgactgccagtgtttggaggcatggtttctgtaagcttgttgcgcagcagtcaagaaagatctggactcgaggacattggtgtcagtgtcacctacctagctacacttggtctggttgttgacattgtacttcagggctgtgggtcttccagggccaggtcagaagcctgctgatcgacccaaagtgtggatgatggaagctgtggagcagggctgagggtgaggagagaaggagcccattaaccacaagctcagagtatactctgattccctaagaaggctggtccaggaccttctgagtcaagtctgaggttctgatgaagggagaccatccgcatagtagaaggtccccaagattctgatgaagggagactatctgcatggtggaaggtccccaaggttctgatgaagggagatcatcccgcatggtggagggtccccgaggttctgatgaagagagatcatcctgcatggttgagggtccctgcagttctgatgaagggagatcatcccgcatcgtggagggtccctgaggttctgatgaggggagatcatcctgcatggtggaaggtccccgaggttctgatgaagggatatcctgcatgatcgagggtccctgtggttctgatgaggggagatcatcctgcatggtggagggtccccgaggttctgatgaggggagaccactccatatggtggagggtctctgcagttctgataatgggagatcatcctgcatggtagaaggtccctgaggttctgataaagggagatcatcccacatggtggagggtccctgaggttctgatgaagggagatcatcccacatggtagagggtccccaaggtttggatgaacggagatcatcccacatggtggaaggtccagcctggcagtgtgacccaaagtggcttccctaatctttctgagcctctgtttctacaaactctaaagtgcccactcaccaggggtaactgttgatttttactttggctccacaatgtgagtgtctggtatatttccagttacatcgtaggaactcctgtgatggcatgaggagggtgagggtgatggcatcccttgatgattcctgccgaccacagcaggtacctgcagtccctgtagttcctcagggacactcctcacacccgttagggaacagttcaccacagcatccttccacgtcctctctccaggtgaactcagagatctgttcattcaacaagaattgatggggcacctgagtcattcttctaaggtagttgacattcccagtcctgattcatggttgttccatccttatctcatctgttacctgtcaccgatcatgtacacctttctatctttgagtctgttttgcacatatatacaagtaaatcacatcgaagtttaaattgtctcattaatttgtgaaatgtgattacaaaattcttgaaatcacatttctatcctattaggaaagcaaaaaggagaaaacaattttgaagcctaactcctaagagaattgctgtattacaaggagacagggatgctgtgaattcgttacaggaaagaggatgtcagccctcatgcctttgtctcccaagggcctggactttcctccacttgatttgtagagagtgcttttggaagatgggtgtgttttatttagatggtacaggtgtcagaaggtaagaggtgtgatggaagttgataggtgactgttacttgaaggaagggggaatgaagtctaaaaggttagctacacattttatctccctgatctccctatgatgcaaagaacccaagaatgtgtctttgtaacaaaaactggttgttacatggacagtgatcagagaaatcacttgccgattagaatttctccctatgtagcattccatgaaataaacagacagctgctcctggttcccccagaaaaatacagatttgtaaaaaaaagaaaaaaaaaaatactacttgttaccaaaatgttttctgagtatattcttttatcttacagaaaacatctacgtattttaaattattgttgtggaaaatgtatacacacacctacacattcattgtaagaaattccaaagtaaaagtttacctgaaattctgtcatgctgatatttattttttaagttaaatttttttttttttttactgaaagtaataattggctgggcatggtgacttatgcctgtaatcactttggaagacgaaggcaggaggattgcttgaggccaggagtttgagaccaatctgggcaacagagttagaccgtgtctctaaaaaatattgacaagttggctgggcgtggtgctgtactcctgtagctctaactactcagaaggctgaggtgggaggatcacttgagtgccggagttcgagtctgcagtgagctgtggtcgtgccactgcactctagcctgggcgacagagcaagacccattctctaaaatcaatgagtaaataaatcataaaaataaaaataattgtagatatctgtggggtacaatgtgatgttgtgatacatgtatactttgtaaaatgtgatatatcagctttaatattttggtggacaccctttaattcatctctgttacaatatacatatactgtatggaattgtgtgtgtcataaatgaaaccatggcttctacttcagtgatatccattgtaacatctactgggaaggttggatgcccagaagatatggccaactaaattactcagtgtatgaacaagaagcacatcatgtcgtcttaaaagtgattgtgttcttatacatttttattgtggatgagttagaaaatatggagaagatagaaaaggtgctaagagtataatccaaccaccctaggaagactttgtcttagtccctcagggctgctattaaaatgccatggatcttctggatagctaaacgatgggggctcctggagggtggggctttcaggtaaggcatggataccttgccctacccatctcttcctttggtgttcatcagtatcctttgtagtatcctttattaaaaacagtaaacatcagtgcacacttaaaagcatgataattgccaaaagaatagcttctgaagaccatgggttcagaggtctgaaacttggaaatcactcaagggaccctccgcctctctttctcttgcgctgtctcccagatgctgccacaaccagttgaatggtataacattaacaataacaattaattaaataaaagatatcatacactgggtagcttaaaaacagcagaaatttatttctcacagttctggaagctggaagtccaagatcaaggtgccaatagatttggtgtctactgagggccagttttcttttctttttttcttttttttttttgagatggagtttcatgctgctgcccaggctggagttcagtggcacgatcttggctcactgcaacctccgtctcccaagttcaagtgattctcctgccttagcctcccaagtagctgggattacaggcgtgcaccaccatacctggctaatttttttcttttctttcatttttttttttttttttttttttttggtagagacagagtttcaccatgttggccaggctggtcttgaactcccaacctcaggtgatctgcccacctcagcctcccaaagcactggcattacaggtgggagccattgcgcccacgagggccacttttctgagtcaaagagggtgacttcttgctatgtcttcacatggtacaggggacgaagaagatcctttgggctcttttatcagggcaacaatcccattatgacatctccacctccacagcctgatcatcctggaaggccccaccttttaataccatcacgttggtgattacatttcaaggtacaaattttgggggacacagacatttgcaccatagcagacttacattgattttgtgctgtatttttttcctaggcctttaacttatatatttcaaaacctaattagaagggtatagttgagagacaggatagccaagtggacaagagtccatgccgagggagcaactcgtgtggagaccctggacgggaagtctccccgcacgtcgattcagagaaaggtaacggaataaacatgggagatcttggtgggagaggtcagagagagcgcggagggccagaccctggcaccttacagcatcctacatacttgggctttacctccagagagatgacgtgactggaaggtttgagtcgaggagtgaggtggcctgaccaaggtttgatgggactgccctgtctgctgtgttgggaagagaccacaggtgaccaagggctgaagcagggacacccttcaggaggctgtttctctaattcagccaacaagtggctgatgttcctgcacactagggaggtggtgatcagatatgaaaaaacagcattccaggtcagataagatgtggggaatgagacatgaggatgggccaaggatgagaccaagatctgggcctgagcaactggaagaatgcagttgcttcgtgttgtgattgggaaagctgtgggagaagcggtttggggttgaagttttctgttttgcagatgttgggtttgatgtcctgggaagttgaataaatgagtttaagagcaggctagaagttgggctatcttcttaggagtcatcagcaactagatgatgtttacagccttaagatggatgagctgagaaagggagtgaatacagatagaggagagagcagccctggggaaagtacagacttgtcaagctattgatagcatatttgcaaatggctttgaagaaagacccagggcactttcccaccagcagtgggtgggaatgagtgccgtactgcacacttgtctgttctctgtattactaattttttaatcatgaccaccttgaaagaaaagcttttcttgctaaattactgtttgaattgtaatttatttgattgtcagacagggtgaattttcataaaggtattagtcatttgcattacttgaagtgaattatgttcattttccataattctaagtcaaagagattatgttttattctgacatcgtggaagccactgaacatttttaaagagcacagcatgatgcagatggctatttgggaatattaatgggaaagttcctatccttgcatcctcttttattcattcatcagtgagtctgactccagagcttcaattttctgaaaagtttggaaaaactagctttggataattattagtcacgtgcaaatgagttaactgggtattaatggaatgaaaccactgccatttcttgctggctacagtgtgaagcaaccacttagggtcatccgtcagccttgaatcaagacacagagtacagaagacagatttccatcctcttctttgcctttcttcttaaagctaattatcagctcaatcctttatttcaccccttcctacaacaaaatgggatgcactagcattattcatatccagccttctctcagtgtgtagtcagggtagtcactggtgggtcattgtcttcatggaagatggtgtgacttccatacttagaaaccagcatcctctgatgttctcagcaggatatggctcctattgtattgtattgtattgtattatatttttcaattgacaaaattgtgtgtatttttcatgtacaacatgatgttttgaaatatacatacactgtgtaatggctccatctggctaattaacatactgcacaccatggcaactacagttaataacaatgttttgtattttgaaaatctctgagagagtagactttgtgttcttaccgaaagactttttaaaggcataaaacatgagtggttcacctgctggctctcactaaatcctctcatgcaattggctcaaaaatcatggaatagacagttcagggaggcagagtttggcttttggaattgctttcaggacctgggatatgttgtaaggacatggtctcttgaatatctggaatctgcaaaaaatgagtagtggcaactggagggactgggtttggggaaacatctcttgagcttggctctcaactaagccaacagtgccaactctgcttcataggcgcagcttgttttagaacaatgtgactaatttttttacacagttctgaaagcaattctctaaaaggaattccaaaaatattttgaacagcagcattattaagattagctgtgttccatcccaaggtgactcctgtataggaaatgacgctcactgggatgtatctgtctttcttggcctttcagaagcagtctcgggagattatggtcacacttgtgtacttgcagctttcccatagaattaaaaaccctgactaattaccagaaactcagcatttaaaatcactgtggataagagtcaggctagaactataagatcatgttacccactttctgtagggaagtataattcagcatttcaaatcagaatggaggtgcttcaaagatttgccattttaagaagaaaaaaaaaaggataacattcatcagagcatttgccaagagacagtcttagcactaaggcagctctcatccttctggaagcttgacagtcttaccatgatggtgaatgagacaagttttactatcatttcaggctcattgctgtaaatgtaacctttcttcaggtgaatgtcctaggaagaaaaatattgttccttacagaaaaaacaaacaaaaaaactagttaaagtatttcatgggaaaaaaactatttaaattcattattctgtcagattccgtggagggcctccgaggctgccagaaacagccctttctttgagcacttatttctgtgataccctgagtacacaaattccttttacaagtgacttttcctcagacaacaattgaattctaatgtgtttatcttgaacttgtattatggctggtagcctaagcattgtatttcaacagcctcttaaaagtgtccataatagatgtggaaaatcaaagtgccacacatccagttgtttttcagcttttggtgccttaatttgcatcgcctgatcagctgaggatctgctgagtgcagaaacaatcttcgtgcaccggctaatttatagcatggcagaacagttgttttctagacaacttgtaaggaaactgcttctcctcatttgtcttctgatcagagctgcacaagaactcttgatcatttacaaatgacgaaagtgagacttgtaaaaggtgagagtaaatcttctatcttattctcttattgtttgctacttggctttgatttatcattttgtgcctttttttttttttttttaacagaatctcattctgtcacccaggctggagtacaatggcgccatcttggctcaccacaacctccacctcccgggttcaagcaattctcctgcctcggcctcctgtgtagctgggattataggcatgtgccaccacgcctggctaatttttgtatttttagtagacacggggtttcaccatgttgaccagggtggtcccaaactcctgacctcaggtgatctacccactcctcggcctcccaaagtgctgggattacaggtgtaggccactgtgcccagcctatcattttgtttatatgaactataagccactagcatccacaaagggggaaatgtcttctgattgatagagcttccttttcttttttgaacaaatgctaagaagtagcaacagccaaaggacaagagctgtattgtcttctctcatgtgtggcaagaacaaacaagattgagaatctgattgcattgaagaggcattgttcattaaacttcctccagacctggggaagaggataaacttcctccagacctggggaagaagataatctgttccacagaaaatacagaatgcataacattcaatgaactttgcacagggatcccagaagtcttggctgtgatccaggacctaccatgactttctttgtttccacctcctgatgatcttaacccgtgtcatatagtttggctgtgtccccacccaaatctcatcgtgaattgtagctcccataatccccacgtgttatgggcgggacgtggcgggaggtatttgaatcctgggggcagatttttcccatgctattcttgtggtagtgaataagtctcgcaagatctgatggttttataaaggggagttcccctgcacacgctctcttgcctgccgccatgtaagatgtatctttgctcctccttcaccttctgccgtgattttgaggccccctcagccacatgaaactgtgagtccattaaacctctttttctttataaattacccagtctcaagtatttcttcatagcagtatgaaaatggactaatacactgtgtaacctctaagtttcctcaacggtaaacaagattttttttttgaccaatgatctctaaaattgcatttggctttaatattctgtgatttcatgaaaatttatattaaatttgccttatgttccatacagctctaagctgtctctggctaaaatagggaaacattgtacaggcactcccaggaagggaaggacgctccccttttgttctgtccaatttgggtaaacctttgtctatgtttatttataataactagaaggaaaaacagtacaagaatattctgtgtctttatcaacagcacgaacacttctgccatcttaaataagttaatttctctggatgcttcactatctggcgttgcaccagctgctgtgtggctctttaataggcatagaggaaacaagactataagcctttcagatcatgcaatgatttctctctaccaccccatcctttaccttttgttaaaatatttgcaatgcccttcacattgccacattctctctctctctctctctctctcacacacacacacctgcatagaaacacacaccacaggtcgtctccccttcccttttagttcccccccagcaggcagatttctctccctagccatgtcctgtgcagcctacactgtgccgcatcctgggttgtttagagtcccatagggcatggattggccagccacagcctgcaggccgagcaggcccccaatgtgtttttataaatcatgtatcgtggatcgcgtgggaacacagatgctgtttgtgttcatgctttgtcagtggctggtgcaacaacagcagagttcagttgtgagggacaaccatgtgtttgctgcagagcctaggctatttactttctgggcctttgcagatgaaagaggacagccctgctgtagggtgacgccatcatcatctctaaggactgctctcagggacaccatccctgaagtgtgagggattcaggggctcccctcatctaatttgaagcaccttttgtttttccctgtggggcctggcgacagggtacttctgtggctcagcaggcagcaggcaggtgagcgagctgtggccaggtgctgggaggcctccctgtggccacatgtagccttcgagggaatgtactctgcaggggtgtgaaagcgccccttctccttttttttttccatcaaggctgttcttgtttattttgaccagataataaaataacagtgtggaataaaataatagttgtgtaaaggaagatagttgaggttctaaggccagcatttgaggttctcttccacattttggggtaactcatgtaaatacaatataagcataacttctggaagctcattaccctaaatttgacctgctctttcccaacttattatagttctagagtgtctatttctgtaaaatatagggatatgcccaagatattcatctgaaggatcactgcacctgtgtgtgtacacactcacgtacatacaaacacgagcagacactcacagctgtcatctggaagaggagagtttctaggaccacagagacagcagtgcagaccttgttttgctacaaaacccacttgcaggaaacgaggaagcagaacactgcccagatgctttgctgagtcagggcagcgggagactgtctgtgagctgcacagtctcagcatatggtgaccaggatggatcctggtctgcaggtcacatgagccgacactgccagtaccagggaggaggctcagtgccagcacgtttggatggaaatgaaaacaaggcttcggcactgaggtagcggagggtccgtcatagcccagggtgccatcctggctggaggtgcagggacagaaggcccgggggaggagctcagggaccagccccagggatggcgaatgtcctgacataacgctgtgcccatcccagtgggtgctgaggaagctgaacggcagtgctgactctgggcacagtgatagccaaacaaactcctcacttgctgggctctgcggggcagacagtgaaggggagctgcaggtcagcagacagagagggaccagtgtcccgtgcatgccagagaaggggggggacgtgcccggtaggagggggagtgagtcatgaggggccctgtccgagagggatgccggtcaccacaccgggctcctctaaccctagcgttagtcatgtgccctcagctggaaagtagacaacttctcatgtcagcgtggcacatcccagcattgaaatcccacgtacaccggcctaacctcccacccaggcttctctccctaacctgccgcacagagtggaacctgcccctggctcagctggtctccctgccgtccgaggccccgttggcccctctcgattatgatccaggcttagtggatggcagcacagtgcatggtacataaagaaatggcatcatgcttggtacatgtcattttgtttatcctttacagcagccctgggaggtgtgcgaccttggtcccctctacaaatgaggagactcaggctccgttgcagaggcacaggggcccctgggctcacagcctggctcagaccccaatctgcagacttccccaccaccacgcgctgctctcccgttcacctgactccaagcttccagtcaaagtcggctttacaaggctttggtgggctccccagcccacacctgtgccccctgatattctaagggcggttatcacttgtagctaagacctggggctggttacatgttgcatcactctccaaaggcctggcccggagctgtgctcatgatcatcaacatgcatgtgatgatctaatcagcagtctgaaatgttatttaattttcttttatttccaagaaatctaatgtcacgtgaagcccttagtccagcacggggctgggtgcagttcccttaagggggaatgtaaagctattctgtctgtaccggcatctgcgctctaatactccctagaaaataagtaggaatcacagcaaagtgcaataggatgcaagttttgtctcctaagaagcttataaactggtgggtggagacaaggcattaatatctggatgggacaagcagggcagtgatgcagaaaaaaacacctctcagtatatgaaatgttctccaggaggtcagatgatccctgtcaggagctgaggaactgaagacaggccagcaggatggctggagcggccaggatggggctggggtggggaacgtcctgcagctgttctggggagaccgcgagctcgtcaccccacggcctccacctcttttcagtgcatagatagacggtgttcccatcttcccgcacgtagacagagtctgggactgagttaatgccactgaaatgtgagaggaatagccgggcgtggtggctcatgcctgtaatcccagcactttgggaggccgagacagccggatcacaaggtcagaagatcgagaccatcctggctaacacggtgaaaccccgtctctactaaaaatacaaaaaaaaaaattagctgggcggggtggtgggcgcctgtggtcccagctactcgggaggctgaggcaggaaaatggcgtgaacctgggaggtggagcttgcagtgagccgagatcaagccactgcactccagcctgggtgacagagtgagactccgtctcaaaaaaaaaaagaaatgtgagaggaagtgacgcgtgacccttcagtactgcctccagagccagggatggtacgcttctgtcgtttatgccaacagtgtttgtgggactttgtatggcagccagagtggactcacccacaaccagagttccacagggagagaaaaactcaaggtcaggactcagaaatcttgatcaacggacttacttgcaattggcctctaggcaggtgtggtcgctggtggacttagggtcccatggaggaccttggggaggctcagatcccaggaaagcagctggggaaccagggcggctatgaggagaaccccttgactcaggaaagtagtctggtctcaagttctagggccacccttaggatagccagaggaaggctagaaagccctgtgggcctccagcttccagccttccaaaagtgaggaggtggggctgtaagattacgctggctgatggctgtcgcaaaacactaagtttattacataaaagcctcaattccctcctaactatcaccaaaacagatgagttgtggtgtccagctcatcatcattgaagaaagaacacctcctttcttcaatttgttcttttgtgttttcttccctcttcagagctaactttttttttttttttttttttttttttttttgagacagtctcacttggttgcccaggctggagcacagtggcgcgatctcgcccactgcaacctctccctcccgggttcaagtgattctccttcctcagcctcccaagtagctgggataacaggcgcccgccaccatgcctaactaatttttgtatttttaatagagatggggtttcaccatgttggccaggctggtctcaagctcctgacctcaagtgaccatctgcctcgccctcccagagtgctggaattacaggcatgagccactgtgcccagcccagagctacctttgatgcccattttcatcatgttcagcttggtgttggggaaagcacaccaggagattcctgcccagggatggccctaggacaggtcctggagctgcccctcagagtggcccactgcatcacgtgaagcaagaacgcaccctttggttaagcctgttggaattacacatgccagatcccattcaactgagggaaaggatgacataggttcaaaaaaatatatgacaggtgctacgagggctgtcctagttctctcttagtaaggagaacctctgagacaggggcaagaagctccttcctgcagtgtattacatcctattcagagtccctttctctctgaagaatatgatgagctccctgcaaaatctgatctcctccctggttggaaggaatgagtggaacctgaaaagtgtggcatttttattgtccctggaatctgatctattaccttttctgtcctctgcctttcatcttcgttctactcatgcgtttgccccagatgagcaggtaagcttttcagatctggggattggggacttcccattttagatggaagtcctgccattgggttggctgaaaaggtgcgtaaggaatctgtcagatttatcacatggaagtctagggcaggcactgaaatccttttaggaaaaatgagtttccagggtagagaccaaacctctaagtcttaaagagagcaaagcaaagaagttgacatttagatctttcagcaaaccatgaagattctctgcctgtaggtgactagatgctagaaagagcctaatggatgagttgagaaagaaaacagccgagtcaagattgctaatgcgttcattacatgcatgtgagtgctttgctgtagaaagttatcgacgtccaaccccatgagaccattactgtcccatttagcctgacttctctcacacggcctcctctcgccttccctgcaacttcatttttagtttcgtattcctcaagacctatcccttaaagaaggaaagcaaagaatggtggaaaaattcacatccataaaagggtttctaaagctaggagccttgctaagctgcctgagttgtcacattgcagagtgcacggaatggccggctgagtctcatcagtgtggtggtggttacacacgctcattttgcctgatcaaatcgtttcattaaaaattcttaagctgtagacacaaaagtactttttcaaatacatcagtggcaatacagaagtagactgtaattcatttgtgtgcacttataatacaacacacctccccaaataaaatgcattttttttctgggtgttcactgcaatttgctacaatcagaaaaatcataaagggtagaatgatgtcattttttaatatattattttcatttttcaatgcctcgaagaaggtgcattaagatcatccattaccttagcgatagtactgttagtcccatacttcatatacagtacaaattcgttattatcagttaatattgacttagtgctcaaagtgttctagataacacacagtctataaagtacaagcgttaagtcacagccatttgcaatttctcttctgactgccaagaattaatctcttattcaacaaatattgttaagtgcctgctctgtgccacagttgggagcaaaacagacatggcctcggggctcagagagtgcacagctttccagtctagcaacaaagtcagacgttaaaccaacaattactgaaattagtcttaaattatagttgtgacagagacacaaaggtgagtgtggggcactgtgaggagtctgaaaaaaaaggacctcactcaggctggggttagggattcctccccaaagactggtttctttgaatggtttcattcatttgcttgccatttatttgaatgtgtcaagtcttgtgctagatttaagaagataagaaggtgaataagacagaattctgattctcagggaactccatgctctcatatgaaagacagctatgaaagcaaataattgcacagactttcatcatatcactttattgcattttgctatgaaagatactatgctgacatgcctcctggaaagaggaaccagatggaagctacacagattagataaaccagctggatcttagaagatcagttgataacatggcagttcatacagcatgaagttttctcttactaagctaaagtcgagaaacatgcccgatcgtaaggagcatcatcaaagtggcagaaggtgtaaagggaggttagtgttttgactgtatgctgggccagccaggacaagacatggcatggctccttctcacaagtaaaatcatgctaacaatgcactgtggccctctagcttcctcctccctcttttgagtctgtctgcagggaacaggcttttacagttccaggacataggatgcagaaagcacccagaaggaaagagggaaaactcattttgtcagtccaccgaaaagctggtgctgacctagccatgacagcacttccttccaaaccagaggatctatttgaatattggccaagggtcacagacatggagttcccatatatgaaccctccgttttggctttggtgggattgatatggacaaaacacgccgcaacttaagtgttgaagtcaagtgttgaagtcaagtgcagagtcacttgactctgtagcaatattgtctcaacaatagactaagaattacttgtgagtggttttgcactgaaatagtctctatgaggttgtactaggtgggccctaattttatagctaggggaactaaggtcccagagaggtgagctgatttactccatgtttcatgacacacagaaacggggatgggaccacggtctacccaccccagctgcagtgactgcaccatgggaactatttccccttgcatctccctgtaggactctgatgattcatgttgacatgtgttaaatgccagaggtgaagactttgacccatagagaagagagcccacctggggactaagcaggacttagttaccactccagctgccacctggagtaatcttcctgtctctactctttaagccccaattcatgtaagatctgaataaaagcggtgtgttcgccaagcatatgcgcagcttcaagacaaggtgtctggccttttctttcaaccagattgcagctccgaaatctctcctgtagcgaaacctggaacttccatagacattggtgctcccatctctgcacatgggagagggcacagtctgttttccaggagtgactgattgccttcaatagatcaggaaactaaccgcggacagaatcagttctacactgattttatactgtgaatgtttaaagtgaggcgttgtccctaacggaagggttagagaaatgtgcattgcttaatgggtttcttatgaagattaaatgagttcgtgcatagcaggcatggaacacacagcagtggctagcacaaaaatgagcccttgatgtgttggaatgtgttgtcattgtaaaccagccactgttggcaccagacagcctcggggtgctagagctgcctgtgacccacgaatgccatgtgaacaaactgacacagccatggcattttctctaaagcaaacacatgaactcagcaggtccctgaccacagatgtccatggtgggaggtggtgctgggtgatgtctgtaatgaagcagagattcctgggcccctctggggtttggtggttaacaattcatcccagtagtccaggcctggatcccacagccatggaatgattccctggcaggacactgctggagagagagggccccacagactccatcacttgggtgacctttggtataaaaggaaggaagaaacaggaaacaggaggtgactgcatttatctacagcagcctcagctgtctcttggcctctggggtccatgctgcagctctgagtctttttcagaaacgggaattcaaaggataaggttttaaatcattgaccatagagctgaaggtgtatcaggtacacagcaaggtaagaaatgcagtcccaatcttttcactggagtttctgcatggataatcagaggagttttcagaacatgctagataagaaacaatctctcttgcactcctctctccctctctctgtttctgtttgtctctctctcctttcctacacacttccccaggaaagttcgatttccataagctcttgtagctgcatattttacctgtggctgggaaaaaaaaggaatgggtagcaagccaagcacctctgaagcgtttctgcaatggcaacttaaatcttctgtgaaaagatgctggatagagaatactggatgagctgctccagtgtggaatggtgcctgaggaattgctattccccacctctattcaatttagcaccaccgttgtgcatgtttcgattaaaaagaggaacaaaacatttatgtactcattcaattcaccgctgcctttttatcacgcatcttctgtgtgccaggcaccaccccacgcctggcatcctgccaatggccatccttcccagggctggattttgcctctcctctccttgcgacttacaagaatttgcatttaaactgcacacttcacctgttggttgatacccaaaaccttcttaagagggaagaaagcttcttcatgacatcctcaatgacacgtaagtgccagttccctgtgagatcttgagggtgtggacaggtggccctcagaggcattggctggaattggatcctttgctgaatgctgcatactttaggaatggacggaggagcttcctgaggtggagaggaggtcagtaatggggaggagagagggcaggaagggaggcaggagaccggtctgtaaaatcaattttcccaactaaaaatgtaatgtcaggaggtagctgtgctccaggctgctcagatgtacatctaggcctgtctgtgtgacactcttgccagagcgggctgtgtcttgtgcagtgggcacaggaaggtgggatccctgggctgctcacgaggccgccccacactctgttcaggagacctagttatgagacggctgcctgtggttgcctaccattctgcctcttccctgccacctcatcagcacttttacctgtcgcctgcttatttaaacacgtggtccagcaatcacagtgagtgtggtgctgactgttgaatgcccatgctcagggaggcccttcacaaattctcagcaaggacttctctctgatgcatggttgacctgatgctaatggtcagctggccccagcgacactctggcattattttaccccctctacactttccctagattcgcctttccatcccctttttgaccgttctgattttgtaaaagccttgtttttcaggaaataccaatatacccttaataaagttttattaataaggtgtttaaaaaggacccagagtcaatgatttcatcaattagagcacgaaatacaaaagtctgaagatccaaaggaatgaatctctaatggccagctcatgacactatgtggcagctagggagatattttcgggcagaggtcttcccttgcctctcaaattctagaagtaaacatctgttgattttgtaatcaacaaaatgtattatatgtccgagagagtgacttgtcttggaaatttcagacatcagatcaattcggtacttgagtcctataccagggccactaaaggacttccagtccaaattccatcaaatcatgtagagccctcttttttgtccttctccatttgctcagctgtttttcctcccaagtagggagggcagggctgggaagcttcatcaagatttcctttgacacgctctggcttcagatagtgatttactttctaatgacgtgcctctgttttcattccctttccagtgtcaatctcagttgcaaacacccccaggaagccacacactcagctccattcagctccagccgtggtgtgaatgaacaaggaagtgagaagagtttttcattgcttattgccagaaaaatgtgtctgccagcttcagtgtttataaaaagcaattttgcctccccctaagctagcagtgtttaataaacatgtaatagagaatgtaggtttaatatttaagcatctctatgccccgagtctgagtgatgctctgctacattctttctgcaaaagggaatttaaaagaatgatgagatccagccccggcctgaaacaaaggcagttccagtggagtctgcagggttcactctttccttccctctctcctcagatagctgctccacggtttccccacttaggcaaatgagcatctgctgtgttcatggaaatcggtccaagtaacacaatagaggctgctgctcctggtgtgtgaaatcatcccccgaattatcaattgaaggaagattgcatcgtaaagccctggagcacgagcctcgttagcacgctccttccagcacagccggggctcggtccgtctggccatgtatttggcaaccagtgtgtgctccggcccaccctcaactaatgggtgtttgcatgggtgtgcgtttgtgcatgtgtgttcaccgccactagagtgagttcttttttggcagtttgtttgaacatatactcacccgaggcgtgtgcttggacctgtagatggacaaaagaggaaggcagcagggccctgccgggtcatgtgatgttgcagcggtgttctggaggacaccaggagggatgggaaggcagcgagaagagcgtgttggggactgcggtggtgacttctcagccaccttcctcgaaggggtggccttctccttagagggatagccagtcttgctgtgacgtggactgggagggtagtgccagcacacaaggaggaggcgggtgtggtgggaggcctcacaacacacggggccttgcaggccataactaggagggaccatcagtttcttatttttgtgtgggttttttttttttttttttttttgagacagaatttcggcccactgcaacctctgcctcccgtgttcaagcaattctcccacctcaacctcttgagtagctgggattacaggcacacaccaccacgcctggctaatttttgtatttttagtagagatggggtttcaccatgttaaccaggctggtctcaaactcctgacctcagtttcttgtttttgaaagatactcaggatgaggctgcagacacaggaactgtctttctcttctttgaacaaaccaagctgttttttgcctcaagcgctttgcgttctctgttcctgctgctgggagcaccgctgtgctttgccctgtccaagatgtgttctttcccacaggtgttggcttagggtaactgactcaggagggtcttcccggcagactgcaggctctgaagggtcacccacccttgcgtacactcatgttgtaaatgagttttgaccctgctggtgccaacaactgctgctctgtgtgttcttttagaatgctgcctggcttggaatgatcttgtttctgtttacttgttgattgtgcatctgctttcttctctttttgtattttttgtgagaagacaggtccatctccctagtttttccctctacggaagttcccagccatgcctggtacagagcatgctaccaattaatatatttctaatggaagccagaagctgggagtccaatcagaaggcgaattgaggtatcacagagcaggaagaatggctgcttggactacatagaggcagtggagatggaatgaagaggatgggtatgttttgagaggaaatggatgacttgtgagactagaaatttgggaagttagaaggatagaggaaatggtctctagagagcacctcgtataagaataagaggcacagggttggcggtggaggcgcttggaggcacagaagggtgctcttcctacttttttcttatcgtaattctcctctgaggatacaagtaaaggtcttattcatgtggataaaattgccaaattttatgtttctcagaagcagttttgtgaatcagtaagtgtgaaggaaatagcccaggtattaaagggaggaatctggaaaggtttgggccgagcagcttccaggggctttgtggccttgggttatccttgtcctcgtctaacctgcatgccgtgttgactgagtatggaattttccccaaatctttgtttttattgacgtagaacacgattgattttcaatcagttgatcaaattcctaagtggagcacactggaatgtgtgtggccaccttctgagggttcatgaaaaagaagtggaaggattccaagagcagccaggctttcaccttcattgaagctgcagcctcgtccatcagaggcacagacacaagaaacatagctctgagcagaaaacacagaatacagctgttactggaaaggggtccagtccagacctgaagagaaggttcttggacctcacgcaagaaggaattcagggcaagtctatagagtaaagtgaaacttgattagagaaataaagaaacaaaagaatggctactccgtaggcagagcagtggcataggctgctcaattgagttagttatttctggatcatatgctaaacaagggctggatcattcatgagttttccaggttggggcagagatttcacggaactgagagttcctccccatcttagaccatatagggtaatttctggatgttggcgtggcatttgtaaactgtcatggtgccggtgggagtgtctttcagcatgcgaatgcattataattcaagcagtgaggggtcactttcattgacatcttggtttcgatgggttttagacggcttctttactatatctcattttatcagcaggacctttgtgacttgtatcttgtgctgacctcctatctcatcctgtgactaagagcacctaacctcctgggaatgcagcccagtaggtctcagccttgttttacccagcccctattcaagatggagtcactttggttcaaacgcctctgacatagctgagcattaagtaccatagcagtttggataagtgggaagtaattgatatggatgggcacaccaggtggggaggactttctggaaatagtgatacattgatggtaaatacgatttggctgtgccaaaaagatggagaattttaggcagagggagcaatttggtcaagtgtgaagacagagctgaccatggagcagtttaacttttcccgacataaaatgcgaatttccaagctgaagaggagcggatctagagcccaaggtggctaacgctgccataagctagtttcagtcccgtctttgctgacggtgtgatattcctgaggccaccggggatgattcacaagggtgtgccgtgattccctttcacagaagcagtttaaaaataaaatctcttgcactccctcttagccaaaggaatccattgaaagccaccaatgtacttcgctagcagtagaagcgtcccatttggtggatgatgcctttcaaaccaggatcacttactgcattcctttcccagagctgccgtaaccagggacctagacctggcaattttaacagcggaaacctactggctcacagtcttgggagcctgtaggtctgaagtcagagcatcggctgggttcattccagggctgcgagggagggtctgtctcaggcctgtcttctcggcttgtagctggctgtctttgtgttcacccagcattctgctttgtagaggagtaaaaataaaatttacctctatcttcttaagttctctagccaggccctataaactagactggcaaaaaataataataataataagagaaaattacacagatttacttaataagtcccatgtgatatggaagccttcctaaggcagtggagacctgaagagacagtgaagacctgaagggacagtggggacccgaagagacagtgatgcctcagcgctttctgtagtatgctggatgaggacgcagaggtcatggggaagcgtgacaggacaaagggagtgagctgagggtgatcggtgggaaccgcagcaaggtctgtgtgctcagcctcctcccggctgcctctgcctttggagatggggatgctgtctccagtggggcatttggagggtgccgctcacaggtgggtcctaggacctccttctggggaggcggggaagtcggatggtccttcctgcgcctgacactgctcacattcttccagcttataatattcagtatgccaaggtagcatctttgtggtagtgtgtcctgaatcacaccagcctctgtgccagtctgtgtccacatttccccttctcataaagacactggcatgttggattagagccataccggtgacctcatggtaacctagttgcctttggaaagaccttgtcttcaaataagctcatattctgaggtattgggcattgggacttcagcatatgaatttgaagggatacaatcaactcataaaattgccatgattttttttcaaataagctgctatttacttttaaaaaataaagtccaatactgtggccatattgctttctgtcaccagcaggtggcatttctatagtccagggatggcaaaggaagagccgagtgctttcctgttgttttatttggaaaatgaagcattgttatgtacgggtgagagagagagcacagattaaactttggaaatgatagtcaatggtacatgatgatgcatggagacttttgccataaattctagacatattacaggaaaaccagcaagcccacaccggttcccatggaagtcaggaatcacactggcttctgggcttgaccctgtcaataaccagcttccaggctccgaccaaaacacttagaaataggaatgttaatactgagataattgtggcccagagacattttcttctctaccttcctcactgtttttttatttttattttttttaggatcagatgagataaaatatgtagacttattcaaaaatgaacaaaatataatacaacttaaacaaaggtcccacttacctgtcctctataatatagactaccttcccttcaaaacaccctccccgagaacagtaactgcgaggaggaactttatttccttcaagcagtaatcaagcctggcccatacgagatattaaacaggcatgaaataaacaggcacaggtaaagatgactgaagaagttattctgattcacatttaaggattgacattacttcaagcaaaattgggaaagaatatgaaacaaaagacgtgtggtctctactctttaaaagctcacagttaattttgctgtatttttaagagaaaagcaaaatggatatatataaaacagattaatagacgactgaattgctccaaaatcattcattcgtttatgacacagtgcggtcctgagactcctcctgcaggcagctggggtggtctctgcccggagcatcggcatgagccgcactgcagtggagtgagtgttgcctggtgttgcccacactgatggatgtctggaagtgcagctaagtgcagccacagagattcactgtaagagcactggatcctttactctgagaaggagatgtggcagtagcgcctggtagcataggccccgtggccccttgtccctgaagcttcttccgttaacagacctcacagagcccagccctcatttccttgcagctcaatccatttctttccagtctcggagatgcttttcttatgactcaatcaagggcttgcatggtgtgtggtgctggcactgctttcagaggctgcctgatgattccgagatccctctgctactttttcgtgcctcatgcgtcttagggaaggtgtttgcaggtgaaggaaaaggtgggtagggtagacgttcaaagggaatcatgaacttgttttgtgtctcttcaaaaaaactgagcaagctgattctcacacacctaaacacgaaagcattttgttactaagctctggactgtaacaccccaaactgcatatgtccctgataaactttattttcctctaatcacttggaagaaccgagtttactgtgtgtaactgcaaggggcaaagagacattggtgagtagaaggtagaaaattcctccttgcatgaaagggaagctggcttctctgtaacaattgttgctatctaaagctagtgggaaccagctggtgggaataaactaagcgccccttgaaaggctgaaacagggtctggagggtgagtggctactctagggggatcccagcactgggttagaggccaagctggattaatctagtcaacacatctctaatgttttcctagcttgagtcagcactgagtcgatttggtataagaaagaaaggaaacatattcctgtggggagacagacagggcaagagcacttcttataaaaattagcatacagagggatcattaggctcagcctcaggtggaacaggtgcctactggaaggagcacctcggtttacctggggacagggtaggaaaggtttcaagggacaggaggcatttaagaattaaaattaaacactgaggcttctgggttgaataggagtttgtcaggtagacatggtaggaagggagtccaggcagagatggcggcatgtagaaaaataacaaggcccaagagagccgctgaaacttcatggaatgttaggtgtgagacaagaggaggtagagctggactaggaattggaagcctggttttgaagatccctgtacgttatgcgccgggagtttgtaggtgatgaggaggtatgacataagtctcagcaggggactgccacgatcacatatgcttgttagaaatatgtttgcaggtggagaagagactggtgagaagtgagggtggataaagaagcggtattgagaggtaataccacagcccaggaaggaacgcctgaagtggaaataaggaaagattggcagccccttaggcggtggactcagatggactgtagcattgcttacagagagaggagctgtgagaaaataagtgtcctatttcttaccttgccagttgggtggatgctgacctcattcaaggaaaataagaaggagcagagggcagagaagatggagatgcagacatggacatgtacaatggcaaggaacatatcggtggtggatgcagtaaagagttggctctctaggtctggaacatagaggtcgaacctgaagatcaagctgggggtcaacatgtctcgtggaatgcaagccacgtaggtgtgcgtgcggtgccctagggagagaagacaggatggagcacagggagcggccaacacctaggtgagcagatagtcttccctaggacagctcacggcagggagagaaaccatgagacttgagaagcaacagaagggaatgcagtgagggaaacatttcaagtaagagggaagaaataaaaaaaccggaggtcaaagacaggccaaagttcccattgtctatccactgcactttggtggccctggcgagagctactctgcagaaaagtgagaagtgaaaatcagagccctggggctgagaagcgcattggaggttaaaaaaacccgggggagtgagcgtggaactcgccaacacgcacagttgctcaccctagcacaggtgcatctggacgcaaagcaagggggagagtgagggagaatatctgacctgctcctgtttcagctgagattccagcgggttagaagcgctcgaggtcagtcaggcaggagctggtgagatacacgtatgggggcaaggaaacgctacgagactgaggattgagctccactcttttccactctgtcaccgaatgtgtcaccctcctcaaatggagtgacccaggtgtcggggactctgtctcagtctggatccctccccctggcagtcgccactgacatgctgcagctgctggatgtgcaaataactgatcagccttgctgtccaggaatttacaggcgtggtgagattattttattttattttatttctggatactatcctaaaccttcccacaccaaacacaagaagttttcccttgctttcttcccccactccttgccttggaacatgataatcaagaaaaactgaccaggtgcagtggcttacacctctaatcctggcactttgggaggctgaggtgtggggatcacctgagctcaggagttcaataccagcctggtcaacatggtgaaaccccgtctctactaaaaatacaaaaattacttgggcgtggtggtgcatgcctgtagtcccagctactcgggaggctgaggcaggagaatcacatgaacccgggaagcggaggttgcagtgagccgagatcgtgccactgcactccagcctcggtgacagagctagattctgtctcaaaaaagaaagaaagaaagaaaaaactactgaatgaatctcattaaccttttgaacaatcctgtcactgtgggaagtttgtcctcgtgggttgtggtagaatgtagacctcttaaatacaagacccagctcctgttagcctttgtgaaaagaatagtgttttaacacttagtatatgctcaattaatgtgatatcaaaagcaattttctaccatttgtgttatttcagcatagctgcctttcatgtgtaccctgcaaccacattgtgaaatagacattttcattcccatttcacagaggattaaactaaggccagaaagattaagaaactgtttcaaagctatataggctgctgatacatcacttatatcactaggtaaatctcactcagattcaaatccagattttaattctatcaagtatatgcaaattaaagaaagtgttttattatttttttcctggaggggattccaagaagaagggtaatcgcattttccaaattcagactgtgatgagcacagtttattacggagcatccatccccacatggggtgaaatgtggagaaccaatgtcttatgagcacctttgaatgaaaatcttgagtccttccagcagagaaaggactttttgaaaggtttatttattcctttactacattccattcttatcttattaatagttcataagtctcagctaaatctctaggtcatagtaaatcacatccttcactatgagaacttgagatgacacaagcattcagttatagcaatttatagcaaatgcttaaaattggtatacccacaatctttcaaagccctgtcaaatacaggagtcagtcagatacaattttaaaaggcttaccatagaaagctctaaatctttgcatagtcaagcatatcttaatccaggagaaaattatttttgtaaacctttcctagaagaattttatgtcctgtattacaatcttataatgtggcagagggaaggtgggaggaagggagataaatacccatgtttatctccagcctgcagcagtgaaatgagatagttcaccatgtattccttgaaaaccactgaaaataaatatcaatactaccattatcttttaaaaaaattcagtagtctttcccacttgtcaaaacacttttttaaaatcttcctttaaatttccagagtgtcctcatatctagtttgcattttatcctcaacaccacaagaattaaataagggttggtattatcactgccatttatagataaggaaacggaagccaaagaagttgggtaatttgcctaagatcacacagctatttagagatggaactaaggaaatgacacagatctccaagcatttctgtaaattttttctaagtaaaagatgtttccttcttttcccaccaaccctcaaaattccgtgtgctgtctgtggaattcatgcacagattgctgtggttcggggaaagatcatgcccaggacgtaggggataaagagggaccagacctgcctcatctgtgccctcgctgcatgggcctgggcaagtcggtgatctgtcagtatcccactttcctctccataaaatgataaagctgggaaggaaatggtaaatatcacctgatcacctggattaaactctgacttggaggtttcttggctatactgttagtcagcattctccagagaaaaggaactaataggatgcatgtgtgtgtatatgtgtgtgcacgtagacacacacatacacacaaagaaacaggatagatgagtgcatgtgcgtctacaggcacacatacaaagacatttatttcagggaatttgctcacctcatggtggtgctggcaagtctgaaatctggagggcagcctggcaggagggaaatgcaggcaggtcttccatgttacagtcttgaggcagcactccttccttcccagaagtcctcagtttttgctcttaaggccttctgcaaatcaggggaagcccacccatattctagagagtcaatctccttcacgtaaatgtcagctaattacagatctccatcgcttctataaaatgccttcacttgaacacccagacaagtgtttgaccaaacagctgggcaccatcgcccagccaagttgacatctacaattagcccttacaagaaaatgtcctttggactataatgtttgtctgtaaagtgtcactatcgcaactatgatgtgtgtttctttggacaaaatatacattagttgaatagtaaactctgaccaaagatgtttagtattaaataactttcttaatagtcaaactgcagaactaaaatttaaatttctactaaattttgtgtgtgtctacccataattatctgctgattctcatactttacatttgaaggactctaagctcctgaatacagtacagatattcataatttttggagacggtttaccagattggcacctcatgaaaatggaatcaaactgtgatgggtaattttatgcatccacttgggtaggccttggtgccttgatgtgtgttcaaacattattctgggtgttttgtgtgagtatttttggaagagagattaaatttacatcagtgaacttcaaataaagcaggttaccctccatcatgtgggtgggcctcatccaatcagttgaaggcccaaatagagcaaaagactgaccgccccagttaagagggaattctccagcagacggcctttggacttgatgcacctctttcctgtgactccaacctgttggtctctcccatgcaattttggactagccaagcctccacgatcatgtgaaccaataccttaaaataaatttcttcgtctttctaaatgcatatatcctcttggttctgttcttgggagaatgctgattcgtgcataaacaaggctgaaaggcaatccttactatcgggaaggtaagaaaaatgaatgcaaggtgtcagaagtgatggttggtgggtgtgtagcattggggcaaattgatatttaaaaattaaactctgttcggctagccagccttcttcagtcttcagactgcgagaatgtagcatctctgaattttaacagggcatcatcaagttctgtcataatgttgttatagataagatggaggaaaatcttctgggaggtaggaaaacaaggggtagattaatgtaaacctagagggaaagtcctagtaggtttttagggaccactgttctttattgtgtcctagtgaatatttgtctagatggcttcatggagaaataaaatcttcgtggataaagaaatcatcatcattatcaccgtcatcattaatgggtatgagtacttaacatggcctattttgtgctttatatgtgttaccttatttaatttttataataatacttgttagaataggcattattgttgttatttatttatgtatttattttgagatggagtcttgctctgtcacccaggctggagtgcagtggtgcaatctcggctcactgcaacctctgcctcccaggttcaagcaattctcctgcctcagcctcccgagtagctgggattacaggcacccgccaccacgcctggttaatttttgtatttttagtagagatgagattttgccatgttggtcaggctggtcttgaactcctgagctcaggcgatccacccacctcggcctccaaaagtgctgggattacaggcgtgagtcactgcgcccggcccgttgttgttattttagaattaagaatttgaaacacagaagatgttaacttgggaaaggtcacacagtggtaaatgggagagcagggatttgaactcagtaagtatgatttcagagtctacactcttaacccatgtgcactctcagatatagctactgaatcagaagatgatataaagaaggaggaagtagtgattgtgtggagtgacagatgtggcccttcatcccatcccaccaggattcctttggattgtggtcctataaaggtgcgtgagaagcagatggatgttcagtaccgcccctgggcccagttcacagctgcaaaagtaccggatggagcagacattaaccaagagtcctgtgaccgagccaagggtagacccaatacaacctggtgtaggaggcagtgaagttgacgaacacttcggctgtatcatcagggaagcaacacttagatgtgggcaggtgggggctggtccagtccatgctgctcagaccccacctgcaggggtgctcagtgtagaatcaccattcagaagggagactgggctgaccacggagaggcaggagacaaggcaggacatggaggatggacagtagtgcggtttgaggaaggcctgaaagaattggcagtgtttgctccagaaaagagacagcgaaactcagggctggggataggagatggacgagcatcatgatagcatctcggcttacagagcatagaaagcccaggtgataggtcttcctcttacctctgcagcaagttcatggtgtgactgagggggtggccacagtctcaaatagcttccccaggtgggtctctgtgtcacaggccatgtgacttcaggatcccaagatgctcattctggcacatttttcagcaggacccaaaggatcaggctgtcttcagctgctaagaggaccagtcttttgcgagtctttcttactttcagcctgtcattgggcagatttctgaagcggaacccagtcctggcagcaatctttcttctgtctcagctaatcccagcctcagcacacagtgcaacattttcagtggtcttgtgtctgtaattatctttcactgtttctagaagcaacttcattgtgcaacaccattgctgtctggaagggtcattatctggaatcggttagttctaaccagctccttacaaactgcctttggtagcaaggctcttaggatttttagagtgttaaaaaaaattccgaaacccagatatgttcttagttgtaaattctgactaataataagttataagaaagaagacttcggaaaagtgtgtttgtaaattctttatattgtttctaaatggggtcgattacctgaggagagatgagttcctgccactggtgatgttctatcagagagacaagcaaaacatggaaagctgaagtaaaataacctcagggtaagagggagaaaaacagtaaatggcatgggtgtggggttcagggtactgagatgtcagaaaaatcagtacagaatgtgagggagaaggtgtgaagagtccaaggacgccacctgctcttgcactccgaaccctccccgctcactagcaagtccacagactgtctgctgaatttgtctacaaacagaaaacaaggcactgtggtgcctgttgtatagatgagagagcataggcttggggatggtgaaatgagccttctccggcctctcagactcaggctttcggagtttttgaataaacctaagttagtccacttcccggccacatagaagttggagcagtaaagctgatgggactgtttttcatatgagatgcaaactcctcaggttatggcaagtgagggcgagaaggaggcctgggcaagagaaaggacttgctttattttacatcgctagtttatggaagtaccagccaacactgaaacttcctggcctccaatccagtggggttattcatcctactctccactctctctgttttctgatgtttggaaataaaaaaaatcagaactacctcattaacgctctctttcctctttcatctgaagcagtgtgttagttaactttctcaacaagtttacatgccctttggctaataattgtggagaggacctatgactcactgtcattagtgtagactagctgccctagaaaaattgctcgggcgcggtggctcacacctgtaatcccagcacttggggaggccaaggtgggtggatcacctgaggtcaggagctcaagaccagcctggccaacatagtaaaaccccatctctactaaaaatacaaaacttagctgggtgtggtggtgggcgtctgtaatcccagctacccaggaggctaaggcaggagaatcgcttgaacccgggaggcggaggttgcagtgagctgagatcacaccactgcgctccagcctgggcgacggagtgagactccatcttaaaaacaaacaaaaaaacaagcagatagaccacaaaatagacaatggcttgaacacaataactgcttctgttttcctgtgtaagaggttagtgaggcaggcgcagggctgggggagtgcacttgtaagtgggctttgtcatcttcacagtatttttccaatgttgtcctgaagcgttgcctcattccctccacccgagcaggtagagaacagggaggaccccatgcaggagctgttgcggttctaacacgcatcctattctcttgggcagagctcagtcactcgaccatgcccagctgcaaggcaggctgggaatgtagactaactaggtgggtgagccagggaggaggaggagacctcaccctagccccagctacacttgcaggtcgagccaagagctgagggttttgcatatactgggtacactgattcctgttgagtctgcagcctgatttattttgtgaaactctagaatcatcggaggcggggttgcatccttggtacagccctctttatcattgccccatggctggggctggaggacagcaggaacagacactacaacaaaatcagctctcttggctccaatccctgaaagcccattgctatttctccctgaacatctggcctgtttcctggggtgtgtagagagaggccttctgttccttcagggcctcagctcagcacctgcgaacacagacattaaaaaaaccctcaagaactgcttggcaagcgcttggaacacagtctgctcagtatgcaccttcccacaccccctgcttgtagtaataatctttacctgcttggcagagcacgccgttgaggggatacatcacttcacctgctgagatgagtgcagagattttctaatgagaggcatttggtggcaaaaattaattatgacatatttcaaaggcaggccaagaacctggcctcctctccgttcccatccgatgcttctggtcactaagggaaagagaatgacaataacaataagtcaggacttttttttttctgttgtataaatagcagggaaggctggggcttctgacttcagcaccacagaatttttctgcagtgcctctttccctggcacatagcatgctcgttactaatgggtcctaaatgaaccccaggtgtcctggtgctcacctgtgggttgaatctcccttgctcagtaagtgtagaatccctctagggtccacctattttggagggactcaaactaggagtcccctaattgcattcttaggagaaggatatgacttcttgagatgataaaggagacattacctgcagacatttcaggtggaaagccaaattgtgaactttttcttgtgcagcttctccatcagcacttgctgcttcaccttgcactatgttatggagatggttttgctccttaaacctcatgagccaatctttgctagcttccagcttttcttctgcagcttcctcatttttctcagcctccatagaattgaattgaagagaggtagggccttgccctggattaggctttgtcttaagggaatgtggtggctggtttcaccttctatgcagaccactcaaagtttcttcatgtcagcaataaggctgttttgctttcttatcattcatgtgttcactggagtagcacttttaatttccttcaagaactttgcctttgcactcacaacttggctaactgtttagcacaagaggcctagctttcagccgatctcagctttcaacatgccttcctcactcagcataatcatttctaatttttttttttatttaaagtgagagatgtgtgactcttcctttcactttgacactttgaagctattgttggttgattagctggcctaagttcaatatcagtgttgctttttgaaaagagtaaaaaaccatttggagccaaatcaagcaaatgaggtgtgtgatcaaactctaatcacttagatatctgatatcacttagatatctgatatcataaagtaaaactttatgaagtttggggtacctgtggccatttcttaaaataagacaacagtgaggtttgccccactgattgactcttactttcataaaaggttctctgtggcacgtcatgctattttataacattttacccacagtagaacttctttaaaattggagtcaatcctctccagttgacttccttgtgtacgcataattttataattcaaaggcctagttttagttggacaaaaacacattggtcacattcttaatagccgcaccccaagtgagccaggaaaaatgcttgtaggaaaaagctgtaggaatgtgctcttcaccttcctgcaaaagattagggatggttgatatgtgagggaaggtgaaagctggaaagagtgagtgataccgaactttattttttcataggaaatacaatatttccttcactgagctgactggtcatctgttggaccccagcccagctcagcttagcagcctgtctgtgtgtgcacgtgtgtgtgtgcatgtgtgtgcgggtgtgtatgtgtgtacatgcgtgtgcatgtgtgtgtgaatgtgtgtgcatgcgtgtgtgtgtgtgcatatttgtgtgtgatttctccaggtgccctcatactgtgtggggacaatgagttgattgctcccctgctgtgtcactgggtgatctaggattatatcactgcctgaggacatgagtaccttttcctttgctgtcccctcaggaaaaagcccagtgtttcacagttggctgtccaaagggaggactgttctccaaccttcctaaaggcccatgtgtggggaaggatggcagtgcttctgacattgggcatggcaggtatgttaatgaggcagctggaaagccatgcccggctttgggcttccatacatgtgattatccctaacaccttcttttatgattattaggctttgaaaattgctctgagctatttttaagaagtctcagaataaaaagagatgatctgggaaggtgagaggagccgatgcccagccactgttaagaacaatggtgtttggcatttatctaggtctctcatcatggttcaggcaggaactccctagccaggtggaacctgtggcaggaatccacaagctgtgagttcaagcctcatgccagctgcctaagctcctatgagaagttggtagatggttcatgtcctttttcctcatttttttattttatttttttttaccagggccagtcttctgtgtaggcagagtgggcagaggcacagatcgtgtgattctaggtttatggagagcacgctcttttcaaagagcttccctcgctgctgtctgtgagtttatctgtgacctgctacagcagcagtccccagactttttggcaccagggactggtttcatggaagacaatttttccatggaccggggagtggggtggggtgggatggtttcaggatgattcaagcacattgcacttattgtgcactttatttcttattcttattacattgtaacgtataatgaaataactgtacaactccccataatatagaatcagtgggagccctgaacttgttttcctgcaactagacagtcgcatctggggatgatgggagacagtgacagatcatcaggcattggattctcataaggagctgacaacctagatccctcagttcacagtagggtttgcactcctatgaggatctgatgctgcagctgatctgacgggaggcagagctcaggcagtaatgcgagcgatggggagcggctgtaagtacagatgaagccatcattcatggctcaagttggggacccctgtgctagagcacacacacagccattatatgtcccctcttgtggctgatttgtttactgtgggagcacagactacactgcagaggagagcagagctggggggaaagaaatggcggtggcatcactttgctgggaaaggctgtcttgttctggaggcaggataaaggcagcatgaatgcttctccagaagactttatcttacaagagcctgaatggatgactagctctccaaaagtaaagcactggaagggaagtgaggtgccaggagataatagttttgaagactagtcctgtgaaacggtgtttctttgtactccaatggcctattttaaatccttatcctatttgatactgtctgcagaatctgatgctagtgactccttcttcctttctgaagctcacttcctccttcgctcctgtggtaatagccttccttgccttctctgcaaagttttcaagttctcgtcttttgtgcttctcttcctctgcctgaactttcaatattgacgtttctggttaacaatctaagatcatatggtcactgtgtgatttatgttgtctactccttggtgtcacaaccacccaccatcatgccgtacagtcggtcccagccccttacgtgagctgggtttttattttggaacttcctaacaaacgtttctagatgaagcccacagagacccgatgctcaggaagtaaacctgtcaagaagccaacacattatttgctcctccaaatgttcttgtttctctgtgtttcatgtcttggttactggtactatcatccacccatgtggaaccatctagaagcctaagaatcaccttcagacaccaccttcccaccccacaaatactctacattttagcagtataagactgtagcagtttcttgaatgtaacatgacatttctcatttccataccttcatttatgttgtttattcttggaatgctcttccttcattttgatgcttcacacgctaatacacatccttcaagacccaattccaatgtgttttctattttggggcctttttgactctcctacgaagactaaattaactgttccttcatttgtattctctaaagggtttgtactattttctatacatttattaaagacccctgagctaagacaacctcctaagaaccctcattgtttcaaggaatataccatatggaaaagtagaaaatgagagtaaaagggaagctaatgtgagggtaggagggaaggtgaggcagaagaggtgaaaagaaagaacagagtaaagtccaagggtaggggagttgagtggccacgctcataaggagctttgccacccctcggtttcccgagcacctgccacgtgccaggcactatgggggctttagtgtagatgatttctccctcgtcttgctccttcatagcaagaggaaggaagcaccaaagtaaaaaacccgagaaaacctggagaaggtgcccaggttgtctcactggtatttagtgctcctagggtggctggaaaaagcatcccgcttcaagaggccaccatctgacacagagcacccaggtactctttcctgtaaagcagaagtccccaacccctgggctgtgaatcaatatgtgtctacagcctgtgaggaacagggctgcacaggaggtgagcagcaggtgagtgagcatgactgcccaagccccacctcctgtcagatcagaggtggcattcgattctcataggagtgggaaccctattgtgaactgcatgtgcaagagatctgggttgcatgctccttatgagaatctgatgcctaatatctgaggtggaacagtttcatcccgaagccatccccaccccgtgtcccatccatggacaaactgtcttccacaaaaccagcccctggtgccagaaaatttggggactgctgctgtaaagcatgcacagtgcacgaggcctggttgagctctgagacttggctgagcccttgcagcagaggtgactgatgaggacacagcatcaggtcgtctactgcttcctgaacttgtactgactttcaggtctttttaccttttatttatttatttatgagatggagtctcactctgttgcccaacctggattgcagtggtgcgatctcagctcactgcaatctccatctcccgggctcaagtgattctcctgcctcagcctcctgagtagctaggattgcagacaccccccaccacgcctggccaatttttgtatttttagtacagacggggtttcaccatgttgatcaagctgatctcgaactcctgacctcaagtgatccacctgcctcggcctcccaaagtgctgagattacaggcgtgagccactgtgcccagcctgagtttcaggtcttcaaacaaaagttcacctgctccagagttgttgaaatgtaatgcattttctggaaaacgtgtgtctcattcatctcttgttggcgtttctgaaaataccacaggttctggagacgctaccgcttcatgtctcctagcagcactggccatctacctgggcacaccagggctccgtgaaaatgtgttcctgggatgccagtgtttccaccctgggatccaggaggcctggctccaaaccccaagtctgcacccactacctgggagatgtaggggcatgacagctgctcagaggtctcagtgtcctcacatatattccaggaacagtaggctggttgggccaccggcgccaacatcctgtggtgatttcttcatcatgacagggtttcgtgtctgtgagatgcctggcgagaatctgtagcaggttgcatgagagctggcttggctctgatgctccacattcttctccgtggctcctttcctttcctttcctttcctttcctttcctttcctttcctttccttttccttttccttttccttttccttttccctttcctttcctttcctttttttctttcttccctttctttcccttcttttcttttcctttctttctttctttctttctttctttttctttctttctctctttctttctttcatttcttttcccttccttccttccttcctttcttccttccttccttccttccttccttccttcctttctttctctcagaattcagactttggttaattgtgacaaacctattaataatttctgctctattagtttcctcatacaatacagtgctttatctgtcagccagagtttccttggtgtgtaaccgtggctcttatccagtgtatctcataatatttattttctgaaataatcgagagcatatgcttgttaatgcttttattagttcacatttgagaatgggttgccagtttgcagtctagataatattatggtgtctctgcatctgcctgtcagctgcatctactacttgaatgtttggttatttctccagcctcccctcattaaccattccggttcctccttaggcagcgctcctcatggccactgagcatgaagccaaggtccctgcagtgatatcctacacagacaagggtgtaaatagcttagtttcatcaggctgttgaaaatgacaccattctccatgcaccaattctttttattttattttttattttttgagatggagtctcgctgtgtcccccaggttggagcacagtggcgcgatttcagctcactgcaagctccacctcctgggttcacgccattctcctgcctcagcctcccgagtagctgggactacaggcgcccaccaccacgcctggctaattttttgtatttttagtaaaaacggggtttcacctgtgcggtggctcacacctgtaatcccagcactttgcgaggcccagacaggcggatcacgaggtcaggagatctcccatgcaccatttccatcatatttttgttactctgagtggtaacagaacctgtagctgctctgttaacctggaaacgggcttgctttgtacaaaaaaagttacctgctttcagatggggccggtgttcatttaatttttctgatgacacaaacttgatgatgatgaagttccctacagagaaagtcacactagaaagactgataagttttcagacccttgaggttggccagaactctaaagaagaggtagatatggagagacttggtaaaaggaatcatcctgacgtagtgacagatgggatgtggaagatgaaggagagggtggaatcaaagacgaatcatgaaagcgacccctctcgtggcgttgaaaagcttctcagttgttggagaatctttcacattgtgagctgattagattgaaaaacacacatatatggggctgtgacctgaactatatctgacgaagtcagcaattgctttgtgtgtttgtgcacgtgttcatgtttgtgcatgtgttcatgtgtgtgtaaatgggcctggtgtttgtgactcagtaactttttctaagagaaaacacgcatcctcacccttgcaggggaggcaccagctgtcagtggtgaaagagagagaagggtcttcattcccctcgtcttccctctgctgtctccccagccctttacctcccgccttggccccttctcccgttcatcttcctctcctcctgctccagagaaggaagtaattaaacggtctgtcctgtgttggctttttttttttttttttttttttttttttttttactgcatatagccctttttttttaaaaaattatactttaatttttacagtatatgtgcacaacgtgcaggtttgttacatatgtatacatgtgttggctttttaaggatgtgagacttgtaaaaacaaaatactatgagtagaagtatggaacaaaatgacaagcctcatttaccttaaaataagaaatctcttggccaggcttggtggtggctcatgcctgtaatcccagcactttgggaggctgagacaggcagatcacttgagctcgcaaattcaagtccagcctgagcaacatggaaaagccccatctctaccaaaaatagaaaaatgagctgagcttagtgtcatctgcctgtagtcccagctacttgggaggctgaggtgggaagatcactgagcccatggaggtcaagactgcagtgtgccctgatggtgccacagcactccggtctgagtgacagggcaagaccctgtctcacaaacaaacaaacaaacacaaaagataaaaaaaaaatctctaggtcagaagcagatgctaaagagatccagtagtcaaaggtgaggggaaatgttagagtgtggtcagggttcatcctgcctgcatgacactgcccatcctgtgctggggatgctggtggctttgggcttgtgtttagatttgcagttggggtcatattccaggtccaatgcattttcccatccctgataagctcagcacgatatgtgacttagctctcagtttctctgaaggagatggccttgcagtttgaactccaggagctcctaggagccactgtggaaaagaggccggagcatgaacaaggagcatctaacttcagcctgacaggacagcagcttgcagtgcagtagttacaacaactccgtagaattaccaagcctgccttgtagtgattggggagggagagttggtccgttgtcacattgttgctgtgactagtccattagctgacctcgggggtgtttctctggctcgtcgaacacagggctgttcagctgttacaaagctcgtgtccaacctaacatcagtgtctctctctgatttccttttgcgagcttgagagctgcctgtgatacactgttggtggtgcttcatggaatttgtcctgtgtgcatgcgagatagttttaattctctttcacaaactattaatgagctcacgtctagggttgctagagtttaggaacaggaatcagatgaggaataatgaatttaaagatatagatagaggactctgagaaaaacagctgagttagtgagtcctatctgtaaagggtatggtttcattctttttttatggccgtgtagtattccatggtgtatatgtaccacattttctttatccagttcaccattggtgggcacctgggttgattccatgtttttgctattgtgagtagtgctgcaaggaacatatgcatacacgtatcttttggtagaattatttattttcctttggatatatacccagtagtgggattgctgggtcgaatggtatttcaactcttagttctttgagcctgctcttcacagtggctgggattatcatacactcccactgacagtgtgtgagctttgctctgtagccttgacagcatttgttgttatttgactttttaaaaaaaccatcgagttggtatctcattgtgcatgagacggtatgtcattgtggttttgatttgcatttccctgatgatgagtgatgttcagcattttttcatatgtttgttggctgcttgtatgtcttcttttgagacatgtctgttcatattctttgtccactttttaatgtggttatttgctttttgcttgtttattttaaattccttgtagattgtggatatcagaccttttgtgaaaaatggacatttttaaagctacaatattttggtttttagcatatccagagagctatgcaacctatatcatgacctaagtttagaatatttttatcacctcagaagagaaacttcaaacctattagcagttattccccgtctaccctgtcccctagctcctgaaaaccactattgttttagtttctatgaatttcctaccaccactccatcatactctgccacccaccaaactaatgccacttccattgctaagcccactaggacactccctaaaacttcaatgcctgaccctcatgcctccgtgtattcctaaatagccatcgctgtagtataaccaaaaacaactatcattccgcgcaactatcattccatataagtggaatcgtacatggtgtcatctttcatggctggcttctttcacacagcgtgatgttttcaaggttcattcatgtagtagcatgtcagtacttcattgctttttatgactgagccatcccattgggtgtatttaccacattttatttatctgttgatcaatggtggacattggggttctttccactttgtggctattatgagtagtgctactatgaatatttgtgtacgtgcttttgtgtggacatgtttttgtttctcttgggtagatatctaagagtggaattcctgagtcatgtggtaactccatgtttaacctgatgaactagagggagaaggttggtaccttgccacgttagaatgacacaaatctctcccaggtggtgagtatagctcccaagtggtgtagctcctgtcctggctaagattcagccattttttttttcttgaataaatactcctcagattcttgtaagcctttggttattttgcagagttctgaggagggtgattttgacagttttgttcgagctgctttaacagaagagcggctttttgggataaatttctcatcctattgcttatttttaaaattactttctttgcttttaagctttaatagtgttacttgaactttgcttctaacagatgcatcatatttcagagataaactcattaaatcacatcatattccccaaaactttgacagaaagttacctaagtcaggataccttggtgactggactttcccctgagattgttttccttcattgcacagtaagttcatattctactgctctccctctctttcttaaatttttctatacttttttgtgtcctctttattgagatacagtatgcattcattcacattctctaatttaagagtgcagtttaatgagctttgaaaaaatgtgtagtcatgtaagcacgattatgatacaaaacaatttcatccttaaaaacagcttccctctatctttttacagtcagtccattcctttacaccccagcccttggaaatcagtgctctgctttctaacactgtggttaagtccctttctagaatttcatataaatggaatcatggagtacctatcatttgggtctggcctccttctcagtacaataccttcaagattcatccgtgttgttgcatgcttatcagtagttcaattctttgttattattatgtagaatttcgttatatggacataactcagcgtgttgatccattcaacagttgatggacatttgggttgtttcctgttcttagctaatttgaataaagctatgaacactcatgcataggcaattctgtgaaaatttttattcttttagcaaaatatttagtagaattactggtcatatgataagtttatgtttaacgttattagaaactggcagattgtgacaaatgatgagtatctttttgtgtatttatttgccacctgtaacttcactgacaaaaggatcacccagctccttgaccagtttattattggacattgccttcctattattgaattgtaagatctctaaatatatactgtcaaataaatgtttttcagatagcttattccaatatgtggcttgctgtcatttctttaacaatcttaatagtgccttttgaagagccgagtcttttaattttcaccaagtctaatttatcaacttttttcttttgtgattttgactgtcatactctatttaagaaagttttgtctcagccaaggtcattaagctttattttgtttgtttctagaaattttgtagttttaatttgcacatttagctctgtaatacagttcatgttaaattttgtagatggtataaagtaaagatcaaggatcatttctgctggtatgtggatgtccagtttgttcatgttatgttgaaatggtgattgtctccatggagttgcttttacttgcacttttattgaaaatgaatttgctactgatggatgggtctgtttctggactctattctgttccattgatctatttgactacctttgcaacattattacagtcttgattactgtaacttttaaaaagacttaaaatcaggtcgtttaagtcttcagattttcttcctctttaaaattgttttggctattctagattacttatgtttcaatataaattttagaataagtttgacgatttctgcagaaaatccacttagaatattaagattgcattaactctatacatcaattttgggagaattggcatgttagtaacattaagtgtatttgcgtgtagatctctttatttaggtattttaaatttttaccaatatcacatattttttaaagtttatcactgagattatatttttaagattattcaaaatgtgttatgaatttttaacttactatttccaattgttagtatacagaaatattatttatttttgtaaattgactttttatcctacaaatttgctgaactgttttattgattttgtagtttttccatacatttcttaggattttctacatagctgttcattttatctgcaaatcaagccagttttacttactaatttctgatttttactgcttttatttccttttcctaccttgttacactggctaggactgccagtaaaatgatgactagaagtgtgagagattaaatctctgcctgggttctagatctaaggggaaaagtgttcagtattcatccattcagtatgttacttgtcagtttctcatagatatcatttggcagatatcttttggcaggttatgagagttcctgggttatggaaaatgccataaatttcctcttagcacttccttgcatgcgttctatgaattttgacgtgtgattatttagtgtttgttcatttcacactcacatttttacacagataagtattgagctaaaggtcccataggactgtgctgcaggtctctagagctcaggtcttctgtgaagcacctcctctccaacaccctgctccataacgtctagctttaccgaactcctggaactctgggctttgtgtcctcagttcattaggccaccaggtcttatctcaatctcctttcttaggctgtggtctggaagctttctctaggcagtgagctggggccctcgtaagctcaaatgtttgtttcctgtctattacagatgactctcttgtactgcctgttgtccaaagtctaaaacacatcattcgtgtatttttcctatgttcttattgtagaaaggagagtaaatctagtccctgttattcctttatgctgagaaacagaaatctgtaggtttactatcacactgatcttgtgtctctgatttcatgaaggaagcgtgcatgagagaaactcccagaggcagatgtgctctaggaggagtgaaggacagaaatggcaagccctaggtagcgcatgaggctgggaccaccattctggggttgatgtttctccatcacacattaggttgacctggggagtgtctaggaaaacactgatgctgttttgcctcacaaacactaagtcaaaatcccaggcaccagtgttctgtgaaagctatgcttgggaaactgacgtgaacctatttgtgtgaagcatggggctagctcctctaagctgattctgacctgtcttatgtgaggtcactgagctggctctgagatgcctaccaatattgaagtatttacagactgaagcaatttaggcagcatgctctagtacttccagtatcttcagacaagctgcaattcttctaaggagctgaggggcaggagggtttgatctcacttggtagtacagtggcagttgggaagtgcccgtggacatgtgctatgttcagaattgtcagaattgtggacagtcactccaggcactaatactgggaactgccaatcaaggcacatggtagcaacttagtaaattgcaactttttttttttttggaatgaatttgatcaggtaatttgttatctctgagcctcagtattgtattagtattgccatgtgtaaaatagtctacttctgttatcttccaggattttgtgaaactcacataaaatagaccacgtgaagacatttaggaatttatttaaaaagagggaggactataaatctacttagtatgttttatgtcttaataatttaatttagtctaaaagtgggttagatgtaacggtgcctttagaaattaggtcttgtgtaaataggcattgttttggtttgaattagttcatagaggaaagtaggtttactttaataaataattgaaaacatattaatacaagtcgcaaaaattttttagtgaaaagtgtggaaagaaaaaaaaactacaataaaacggatatggttttctgctttctcgttgttggtattttatttaagcattcattctttatataaggctcactctccttggcttttcttcctctctgaaataaacagacattagtcacatgcagaattaaacgctgctgcagaattttgtggtgtggcatgagacactcagagctgatggaagtctagaaaggttaagccgttgtccgacctgaatcaagcaattcttttcaaacattcagtaaaatgcggccaagtaggcataatctaaaatggactatgtggaggtcccgtgggcaagattggggaggaattcctgggcagtcttcatccattttctttttcctattatggtaagctaactcacagcttaagtcaatccatgaatccatctctagtcctgggtcaagcaacaggggtgggagtctggtggggaatccggcacttagagtaacgtgttcaccatcgctcgtgtgtgtgtgtgtgtgtgtgtgtgtgtgtgtgtgtgtgtgtgtctaatggtaggatgtttcagtctcttctcgtattgctccagagagagcgctgtggtctcacaagtcttctgaggattcttcctggtggttcagaacagagtgtggactacagaaactttaatgtataatgtgttcaggaaagagtacctgtaatattttgcactgttcatttttagtatagaagctgcaactcttgtcttaatctacatctggttttagaaggcaggagttcttagggaaaggctggtgtagcttcattttggcaattttaaaagttttacccgatgaacccttagccatccttgttagtcctgcagacaaccgtgaacataccacagacaaggtgctcagaagggggacttacctatgcaggtccaatcatctgcaaaggatcgggcacattggagcctgaccgtcttaaaaaagcctttctttatgagaatccgtgggctttttctgtccaaggcaaagcacaaagcacttgttgggcctatttaaggcactgcaggatggcatccttgatggggtgtttcaggtaagccacttgcaccttttgtagtaactttcttatagacagtgggctcattcagtgtgtggcagatgcccggcaagcatgcttcatcttgctctgcagtggcaactctctcgtttcccatgtggaattgtgaccatggagcttcgtattttcagagatttagttcctaatgaataaagtattttaaatgtacttatttatttgtgaccccaaaaaagaagggtttgggttagatgatctctttcagctttcagagcctgcagtccctttcctgattccgaatcataaatgtatgggaatgtgtcaatgtgcaagagaaagaggggaacagaaaaagtcaaatacaaacacaagagtattccagttaacttaagcgagaaaatcttccacaattcctctttcttttggattctctcctgttgtctccaaggctcactgactccaacacagggccctgagggtcggttgcaaagtgcttgaacattctgtcctttgtttcacatctagtctcatttcagggtccgtttgttgacacttgaagtcaagcgctgtgtcatcagagagactctggtgcaaggcagtcagctgtttactttgctgcacaatctctgtgcccagttcagccagagagagcagccctgcatgcagcaaaccagaaccaagcctgcagcaggactcaactaagttgtcactctggagtgtttttctggctggaaatgaagctaatccttcctaatgcgctggcttcttcgaccatgtccaagcgagggctcacatttggctaaggcttcgaatcctgtttcagggaatccaattcaattaattcaatgttcctctttacttagcaaatactaaatacctactacgtaccagccagagcagtaggcactggagtacccatgagacgtaaatctaggtacatagtgggaatcttaaatttgctaggactggggaattcgggtgtatagccaaacaaagaaaatgtagtggaagaaatatcaaatgcaaaaaaagcaagaattcttagtttaaaaaaaaaaaattatttcacttatgaaaggagtcttctgtgaaaccacccctaggtgtaagccctggggatagatcgttagaaacaggaccccccacccacccccacagagtacctgggaacttaagcctacaaagattttctagactctctattagagaaattttaccaaaacagttatgtttcaggaaagtggggatcattttacccagtggccttgcaagtttcacagcaagtctccttgttatgggtctacagggaattaaggcaacttgaactaagagagaaaactatggtatattttctaaaaaaaaaaaagaaaatactgcaatgagagttctattttttttttttacttggtagagtaagtcatacctaaaatttccctgtaagaccttggtcaaaataagaatgttattactttggcttaatatcaaaatggtaaaacatgaactggaagtcaagataatagttttctttacatcttaattgcaaatccttcaagaaaaaaggaaaatatgacaaaagcaatatagcatagacattgaatagagactttgaagtcaaaaagcttgaaatcaaataatggctctagccgtcactcaatgtgaggtcggaggcaacttatgaaacctctcttagcctcagtctttccatgtgtaggatggggatgataatatctatttcacatggttattattacaattaaatgagtggctaattgaaaagctctttaacaagtgcctggcatgtagaaaatgctcagtaaatttcatttactatcattcttgttgctactgttactgttattattacctgcagtgtgtgaggtcttaggctgtgcttggacttggacatgaactgggaagggtgaaggggagggtgaactgcaaacctgagtaagggtgaaggagagggtgtactgcaaacctgtaataaaagaagtctgtattgaaagaaaaagaagccaggatccccagagatacaggggagagtgtagaatgtgagggaaccagcaaacccagtgttctctagtcttaaacactgaaacgtctgagacagctttatacatctccttgggcgcatttctctaacagacaacagtgtggaaatctgatccagctaacaacagaaacacgaagaaccaactgcataccactccatcaagagccaaccctggtttaaagtaaagcttcctgtggtgtttcagtcttattatccctccagggatccagaagtcatcatgaagatatttcgctaaaactgcactcgtacgtttaaacactgataatggaaaaatgtattttgccaaaaacagtaagaactgcaacttctattgaaacatactgagaaatagtgttatagtgaaagtcaaagatctgatgttgaatcaggttgggagggcaagaaatgattttcatgaagaaggaagaaaatgaatattttcaaaagctcacctgcctggaagtcacaatgaagcattaaggaacatctgacataaaaggagggagtgtaattcatcaagaggatgcccatggggacttgattgctggactttatttctaagtcaggggaggcatgatcctaagcattctgaagagatggaagggacatcggggctgccactgggcccctccctcacacctcatgctccaccaggagagctcagccttgccacgcggctctgtggcctgggacctcagggtcggggtgagccgtggtcctgctcaggggatagcaccctctgctctgctgtgcacggtagccccacttttcattctgcacacttcttctaagctgcaggagctcctggctctttttcatgtcaccaaagagccttaaatacagaaatcttcatgttttctttcttttttttctctttaggagtctctagactcctcttggcccaaaggttaacatggtaggtggcatttgcattaagtaggtaccaataggggtgtgtgtgtgtgtgtgtgtgtgttgacctttgctttgatcagcttttattacaaaatttgaccatgactacgtttgtgtgcaagagatgccgctggaagtatagtcccaggctgggaagctgctacctagcagcaaagttacactagggaagaggaggtgcacagctgtggctgacagcagcggcctttgccacaatcagtactgggcttcagtggtctttctccctctattatatcacatttattataacagctttatgtgcatgtgtctctaggtcaccagctccttatgagaagtacccgagctgtttatctttctttctccaggccccagcctcattctttctttttgtcctgattttactttttttattatactttaagttctgggatacatgttgcagaatgtgcagtttgttatgtaggtatacatgtgccatggtggtttgcttcacccatcaacccgtcatctacattaggtatttctcctaatgctatccctccccttgtcccccacccccgacagaccccagtgtgtgatgttcccctcactgtgcccatttgttctcattgttcaactcccacctatgagtgagaacacatggtgtttggttttctgttcctgtttgtttgctgagaatgatggtttccagcttcatccatgtccctgaaaaggacacgaactcattctttttatggctgcatagtattccatggtgtatatgtgccacattttctttatccagtctgtcattgatgggcatttgggttggttccaagtctttgctattgtgaatagtgccacaataaatatacgtgtgcatgtgtctttataatggaatgatttataatcctttgggtatatacccagtaatgggattgctgggtcaagtgatatttctagttctagatccttaaggaaccaccacactgtcttccacaatggttgaactaatttatactcccaccaacagtgtaaaagcgttcttatttccccacatcctctccagcatctgttgtttcctgactttttaatgatcgccattttaactggtgtgagatggtatctcattgtggttttgatttgtatttctctaatgaccagtgatggtgagatttttttcatatgtttgttggctgcataaatgtcttcgtttgaaaagtgtctgttcatatcctttgcccactttttgatggggttgtttttttcttgtaaatttgtttaggttccttgtagattctggatattagccctttgtcagatggatagattgcaaaaattttctccctgttcactctgatggtagttgttttttgttttgctttgttttgtttttgctgtgcagaagctctttaattagatcccatttgtcaattttggcttttgttgcaattgcttttggcgttttagtcaggaagactttgcccatgactatgtcatgaatggtattgcctaggttttcttctagggtttttatggttttaggtcttacatttaaatctttatcttaagttaatttttgtataaagtgtaaggaaaacgtccagtttcagttttctgcatatggctagacagttttcccaacaccatttattaaataggtaatcgtttccccattgcttgtttttgttaggtttgtcaaagatcagatggttgtagttgtgcagtgttacttctgaggcctctgttctgcttcattggttgatatatctgttttggtaacagtaccgtgctgttttggttactgtagccttatagtttgaagtcaggtaccatgatgcctccagctttattctttttgcttaggattgtcttggctatatgggctcttttttcggttccatatgaaatttaaagtagttttttctaattctgtgaagaaagtcagtggtagcttgatggggatggcattgaatctataaattactttgggcagtatggccattttcacaatattgattcttcttatccatgactatggaatgtttttccatttgtttgtgtcctctcttatttccttgagaagtggtttgtagttctccttgaagaggtccttcacaccccttgtcagttggattcctaggtattttattctctttgaagcaattgtgaatgggagttcactcatgatttggctctctgtttgtctattattggtgtataggaatgcttgtgcatttttgcacattgatttttgtatcctgagactttgctgaagttgcttatcagcttaaggagtttttgggctgaggcaatgggattttctaaatatacagtcatgtcatctgcaaacagataatttgacttcctctcttcctaattgaatatgctttatttctttctcttgcctgattgccctggcaagaactcccaatactatgttgaataggagtggtgagagagggcatccttgtcttgtgccagttttcaaagggaatgtttccagcttttgcccattcagtgtgatattggctgtgggtttgtcataaatagctcttattattttgagatacgtcccatcaatacctagtttattgagtgtttttagcatgagggggtgttgaattttatcaaaggccttttctgcatctattgagataatcatgtggtttttgtcactgattctgtttatgtgatgtattatgtttattgatttgcatgtgttgaaccacccttacatcccagagttgaagccgagttgatcatggtggataagctttttgatctgctgctgtattcagtttgccagtattttattgaggatttttgcatcaatgttcatcagggatattggcctgaaattttcttttttagttgtgtctctgctaggttttggtatcaggatgatgctggcctcaaaaatgagttagggaggattccctctttttctattgtttggaatagttttagaaggaatggtaccagctcctctttgtacctctggtagaatttggctgtgaatccgtctggtcctgggcttttttttggttggtaggctattaattactgtatcaatttccgaacttgttattagtctattcagggatttgacttcttcgtggtttagtcttgggagggtgtatgtgtccaggaatttatccatttcttccagattttctagtttatttgcatagaggtgtttataatattctctgatggtagtgtgtattttgtgtgggatcagtgttgatatcccctttatcattttctattgtgtctatttgattcttttttcttttcttctttattagtctggttagtggtctatctattttgttaatcttttaaaaaaaaccagctcctggattcattgatttttgaagggttttttgtgtgtctatctccttcagttctgctctgatcttaattatttactgtcttctgctagcttttgaatgtatttgctcttgcttttctagttcttttgattgtgaagttagggtgtcaaccttagacctttcttgctttctcatgtgggtgtttagtgccataaatgtccgtctaaatactgctttagctttgtcccagggattctggtacattgtgcctttgttctcattggtttcaaagaacttacttatttctgccttaatttcattatttacccagtagtcattcaggagcaggttgttcagtttccatgtagttgtgcagttttgagtgagtgtcttaatcctgagttctaatttgattgtgccgtggtctgagagactgttcgctttaatttccgttcttttgcatttgctgaggagcgttttactccaattatgtggtcaattttagaataagtgctatgtagtgctgagaagaatgtatattctgttgatttggggtggagagttctgtagatgcctattaagtccacttggtccagagctgagttcaagtcctgaatatccttgttaattttatgtctccttcatctgtctaatattgacagtgagatgttgaagtatcccactattattgtgtgggagtctaagtctctttgtagttctctaagaacttgctttatgaatctgggtgctcctgtattgggtgcatacatatttaggatagttagctcttcttgttgcattgatccctttaccattatgtaatgcccttccttgtcttttttgacttttattggtttaaagtctgttttatcagagactactgcaagccctgctttttttactttctatttacttggttaattttcctccatccctttattttaagcctatgtgtgtctctgcatgtgaagtgggtctcctgaatacagcataccagtgggtcttgactctttatccaatttgccagtttgtatcttttaattggggcatttagtgcatttacatttaaggttaatactgttatgtgtgaatttgatcctgttgttatgatggtagctggttactttgctcattagttgatgcagtttcttcatagtgtcgatggtctttacattttggtatgtttttgcagtggctgttactagttttccctttccatatttagtgcttccttgaggagctcttttagggaaggcctggtggtgacaaaatctctcagcatttgcttgtctgtaaaggattttatttctcctttgcttacaaagcttagtttggcaggatatgaaattctgggttgaatttttttttttttaagaatgttgactattggcccccactctcttctggcttgtagggtttctgcagagagatccgctgttagtctgatgggctttcctttgtaggtaacctgacctttctctctggctgcccttaacattttttccttcatttcaaccttggtgaatctgacgattatgtatcttggggttgcccttcttgaggagtatctttgtggtgttctctgtatttcctgaatttgaatgttggcctgccttgctaggttggggaagttcttctggataatatcctgaagtgtgttttccaacttggttccattcttcctgtcactttcaggtacaccaatcaaacgtatgtttggtctttccacatagtcccatatttcttggaggttttgttcgtttcttttcattcttttttctctaatcttgtcttcattctttatttcattaagttgatcttcaatctctgataccccttcttctgcttgattgcttcagctattgatacttgtatatgcttcacaaagttcttgtgctgtgtttttcagctccatcaggtcatttatgttcttctctaaactggttattctagttagcagttcctataactttttatcaaagttcttagcttccttgcattgggttagaacatgctcctttagctcagaggattttgttattatccaccttctgaagcctactgtcaatttgtcaaactcattctccatccagttttgttcccttgctggtgaggagttgtgatcctttggaggagaagaggaattccggtttttggaattttcagccttttcgcgctggtttttcctcctcttcatggatttctctacctttggtatttgatgttggtgaccttcagttggggtttttgcgttgtcgtcctttttgtttatgtcgatgctattcctttctgtttgttagtttttcttctaacagtcagtcacctcttctgcaggtctgctggagtttgctggaggtccactccagaccctgtttgcctgggtatcaccagtgaaggctgcagaacagcaaagattgctgcctgcttcttcttctggaagcttggtcccagaggggcacccaccagatgccagtcagagctctcctgtatgaggtgtctatcgacctctgctgggaggtgtctccccgtcaggaggtacgggggtgagggacccacttgatgaggcagtctgtcccttagcagagcttgagcgctgtgctgggagatccactgctgtcttcagagccagcaggcaggaacgtttaattctgctgaagctgcgcccacagccgccccttcccaaaggtgctgtgtctcagggagatgggagttttatctatatgcccctgactggggctgctgcctttctttcagagatgccctgcccagagagaaggaatctagagaggcagtctggctgcagtggcttggccgtgctgccatgggctccgcccagtctgagcttccctgtggctttgtttacactgtgaggggaaaaccacgtactcaagcctcagtaatggcgatcacccctcccctgaccaagcttgagcatcccaggtcaacttcagacggctgtgctggcagccagaactttaagccagtagatcttagcttattgggctccatggagatgggctccgctgagcaagaccacttggctccctggcctcagcctcctttccaggtgagtgaacagttctgtctcactggtgttccaggaagcactggggtatgataaaaaactcctccagctagcttggtgtctgcccaaatggccacccagttttgtgcttgaaagccagggacctggtgatataggcacccaagggaatctcctggtctgtgggttgtgaagaccgtgggaaaagcctagtattgggctggatagcattgtccctcacggcacagtccctcatggcttcccttggccaggggagggagttccgtgaccccttgtgcttcctgagtgaggtgatgccccaccctgcttctgctcaccctccatgggctgcacccactgtctaaccagtcccagtgagacggactgtgtacctcagttggaaatgcagaaatcacccaccttctgcattggtctcgctgggagctgcagatcggagctgttcctatttggccattttggccaggaatcctccttacagatgctgtttattctaacaaccattctgtccataacacacacacacacacacacacacacacacacacacacacacacacacacgtgtcacaagtgaaattttgggcaagtcattagatgtctttgaatatcactcacacagcaaatttgtgggtatcccaggattagaaacaatttatctcaattgttaggtcagagctatttctccttatgtctgtgatttctatctaatgtgtatattaatataagaatttcagaaattatgcagtaatttaaaagttcaagaaacctttattgcaaacacctccttctgcatttcacaggagggcctaaagaaaaactttttcatagaaacatgtacacaagacaatattaccagaaatcaacccccaaaatgaaggcatcagggggcacgaagaagagacttaacaaactttttttcttcccttgcaaattctggtatcctaagaagcagtctgaatgatttgtgcatgaaactgccttggagcaggtgcaacttcagggggaattctcttatttttattgcataaaaaatgaatcctatggaaatacagactcctgttctgctgagttttgcattcgcatagctgaattaggagagggagatccagacagtacagtgtactgataccatttgaaatatccccacttgttcttcatgaattcccccatgaggttgtcatcatttaattcaatttaatctttaaaattcaaactcttttgaaactttttatatgtggagtgctctgatctcatttttggcttctatgacacttttcccttaaaagcaaagctgtgatctgtggcgaggaagtttgagtggtgcatcttccagtctcatctctgccatttgttccagtgtctaggaggaaagaatctttgcactatgcatattcagtgcactagggataaagtggccaatgtgtcttcattccccaagctagaatggtccttcatttatcggccagcctttgctgaacacacaggtcctgccattcactgtacaagggaaagatagagattaagatccaggcaggtccctgctcgcagtgctgactgagtactgtacctatttgcccatgtgatgtgtctttctattttccaatgagagtggaggtccatgttttaagactactttgcctcccattgactgaggattgggattagatctttgattgggctagagggagaggtgagacactttgaaggggtacagaaataatctgtggagggagaggaatcaagagggactggacaaagttgtgtctttatcttctggtccccagattcaccactcccctaagagcaacagcactagctcacagctttagcatgacatcctctgtagctttactcacagtgggaccagttctgtcacagtaggaagaaattctgtcaaggactaatgtcattgctccccgggtggcccaaggcatccccagctgatcatgtgaccagccagcctcccattcttccaggtcagagagaaatgatctacttttttatcttggtgtggtggatgggactaaggaaagaaagagttggggtttgtcatattatttctttactttgtactcagtagattatattgacaggcattgagtaaatccagtggaaacatgaactctccatactgtagtagacattgaataatttgagcagaataacagagagaaaaggaaaatgactaaataacattttaggaaataagctacatttcctagacgtgggatttggcaatttgggatggatggagaaatgaactttgtgtatctctctgaaacaggtgaaattgacattctggaacaaaaatctaactatgaaaaagaaaactctttatttcaaatctatacttgggcaacagtttggggccaggaggaataaaagaccttaacaggtcctctgtagccctctctgacttctaggcgtctgagtaatcacagacacccacacattgttttaaaaccctccagagagagaaagggagaaaaaatgtctttgataagatcaggtgcgttcagggtcgtatggctgtagacagaaaaatgtttttgtttccactggttacacattctgatgtccgacctacatcccttctgatgaaattcaaaccaaacccttttctttcccagtccccattggaaacagaaaatagatatgcatttttcacactttaaagaactcatcatgtaaaaaaattgctttttaacacatttcatgccatcatgtcttccttggaaattttcagtgcctttttttctatttgtctaagtagagaagctatctttctattttttttatggcttcttctgaactcctaccgagacctgttcatctcacatcttcaggccccaaattggatacacaatttttaattaagatgtgatccagcgaagtatttgcttagatcttacagatctggaaaaaaatgcccttaagaaaagactaggcaaatagaaataatataatctccttgcctcagtccaaacttgaaggactcattagaggatgcatgcaagtagggaccagaggaccatgaaaatcctgctgggattgagcgtgatttctgctgagatcactgagatgccacaacattgaatgctgaaagttttagcaggaatcgttggtgaacttttcctttggaattccgcaagtgcttcttgttacaggcatagacaaatgtatactaaaaattacatgtataatttaaatttcagcaagaaatactgttgacttcttatgaggaaaaccaggcaagtgatttgtaaactcttgaagcaagaaatgttgatgtcttctccatctctttatcctgtagagcacgttgcactgagatggccccagaagtagatactgagaaagttctagttgaatcatttaatttgaatgaagctgtgagataaaaggaaaaaaaagaggctacttataaaataaatttatagtatggtcacattatccagagtaaggttagttcggtttggtttgaattgtttcatttttagccaggcacagactgctcagaaagtaagcatttaaaaatttgtcgagatgttatttattatttggtaaaagttgcaatgcaccaagatgtaagattttacacccctgagttttatggcatcacccttgctaatttattcatgattaaaccaaagaactctcaatgaggagaagtagattgcaatataaattggtgtcattgtttgtaaatgtgctccactaagcatatatactgctccactaagacagcttctagtaccatgcctggggcttcaatgcaatttgcttacgttgaatcactggctcccagactccccttgtgaactgaacaggcttagaaaatcattctaaagaatgcatggtttgtgtagttgtagaacgaaacttctcttggaagcttattccccctcaccagggaaggagttagtgggagattctcaatctggtctgcagatgagtgccttctaggtaattcacacatataatttacagaagtgggaagaaatgaattcaaaccatttttttttttccctcagaaaactaaatgtcaatctcattccatttccgttggacggggaaattgacgtaggagcagcgtgaggtagagtggcatgctgaccataactagggtcagtcaccatcggaggacccagcagagagctgtggggtgctgcagctggggaggactttctccatctgtttccccttggtaccattgatttgttgtctgatttaaatatagagttcagtatgcaggtgtgtaagtgcagcataaataaaatggcatcctccttcacagccaaggggccttcgtctgggaaactgatataatttatgagagcgaggcagcagcataaatacgtggggtgctttgtcaccggccagtatggaattggtcagcttggaggaggggaaacagagtcagggggaagacagcatgccaggaggagctaaattggggcaccaggacctgaaccctggaagccagtccctaaacaaccagagctgctcagcaactgctctctaattaccctttgtccctggagaattccagaggggatgggattgcctcagtgaacttaatcttagatgggtggctgtcctccttctttttttcccttgacggaggagggagggagggcgtcgagggtgatgcatcaaactgagggtgacaagaagctggcgccttttgctccacttcccagccaggagggctgacagtgctggagtggaccagtccgcggagctccgggggtctgaatgctccaggggtgtgtggatggcaatggccaggatggccctcctggttgcgacccatcagaaagtggataccactgtcctctggtttgcctgctgtgctggtaaggtgtggtgacgtgtgtgtgcctgtgtgtgtgcaaagggcaaagagatggacagtgttaccattattcatttggaattagaattgtggaggcttgcacatttgtttgtcttccaagttctggcctcacccacccttttttgagggagagaggggccaggaaggaggccgttcccagccccatgagtcaaggagggcatcgggggatgctcccactgaggaagctcagagcggggcccggagaaaggggtgctccaagcggtgcttcctggtcgatggcacgtcggggtgggcaggctggagttgaagagcttctcagcgtggataggaaatcatggaaatgaggaatgatctagcctccagcagtgagtcggaggaataaatgaatcccggaaatgcagtttctgtgaactccagattgctatggagattgcattgctttcccaagacttaaaaaacgaagagtcagcgaaagctgggagagcggtgatgtatggaagtcaggcgggccagcgcgccgggagtggtgggaagggggcttcgcaggtcattacacggggatttctccgcgcagaaaaagggattagcgttttcacctggtggggatttcatgagcttttccctggcctgctcttcccctgccctttcccagagagcccagcttcagggacagcgcccgcgaggtgctgctggggtggcggggcttgtgggcggaggagggcggctctctggtgtgcagcaccgggtgtgagtgtgggtgagcgtgtgcgggagagggtgtgagtgtgagtgggtgggtgggtgtgaaaatgggagaaagtgtgagcgtgtcacagtgtgtgtcactgagtgggcgagtgagaaagtgggtgaatgtgtgcgtgactgtgcaagtgtgtgagtgtggggagtaagatttgtgtgagtgtgagtgtgcaagtgtgtgagtgtgggggagtgagtatggggaggagtgagagttgtgtgattgtgtgtacacacacgtgtgcacacagggcgggccgcgcttggcatttgaggaggggctcggaggtcctcctgggctggccgctgtcctgggagcagggcaccagggcaccctgcgagttttcaccttgccaaggtatgccagaagccggactccagcttccttgccaacgtgtgcgggaagcaggaccccagctgcggtccagggaggaaaaggggggtgctcacagctggggcgagtccctggagcccacaggcagtgacttgccccagaatgagcttgagagagtctggggatggagaacactggggatgcttggtgtggtgcagaggtaggaggatgtggatgcctgtgaggtactggtgcgaggtttgccacgtgttatccctgcatgagagagcgtggaccactgttttaggccaggatagggacagcatgtccaattacacagggctctgcccacctgcaagatgcaaggaggccctgtctccaatgtcccctgacctgacagtcctgccacctgccagcctcgcagtggccagccccgcccccagcaagccccacccctaagagccacacccccaacagctcacccccctgccagccttgccctcagtcctgccccctgccggccttgcctctgccagccagagccagtcccccagcaagccccgccccctgctggctctggcccttctaagccccaccctcaggcagtcccgccccctgccagccccaccactgatcatccccgccctcagacagttttgccccttgccagctggaggtgggcctcctccagccagagtgaatctcttagtaagccccaccctcttccagccccaccctcaggcagccccacctgcttccagccttgctgaacagtcccgcccctgccacccacatgggttcctgggtcttgcccctgactaccagggtgaccccaatgcctccgagacatccttctgccctagaacagccaggagagcagagagaacaatttaaatgctcagaaagacaactctttcttactgtttttgctttgcccagggaattgcaatcagtttcaatacacagttaataaaatgagaggcattcagcgtggatgtgggtgtcaagggagagggctcaggcttgcttttgccttttagtaccagttcctattgtttggaaaacacgaggtggcttccgagaacaggtcttggccctcgcctgccctggagccccctgtccaagggccgccgtgcctcacaggcaggtgcattgctcttgttttaatggtggccttcatggcagtgggacccctccctccatgactgtccccaggtattgcctatggtgttatagtgtgggggcctcagggaagggtaggtgacctgtccacatttaacataattgtaaagctcattgaagaaaagaggacgaaggagtgacgtccaagtttattgagctttaggaagagaacggccagatttcgttttgagattttctcttatttgctggaagtctgttcaaatcatatgtctcttctgggttattaaacggtcaaggttgtttctggatccccacaaaaatgtgaggatacaaagtccccttgggatgtgcagtggtacccatagtcctcgtggttagaggataaaggggtccctagaatgatggagtaataagggcaaggtgtttggaagcaaatgccgagaagaaatgctcccttatgccgtaaaggccaggagactgtggtcgtcaggctgagtggatggatgggaaaggaggaagtaaagagcacacaccggcttttggaagcagatagctcatagcatttgaagagggcattgccatgactctggcctgcctctctcattggggaatcaaatattaaaaaaaaaatacttatatatcttttagagtgatcttctttggtaatttttagtatataaaaaagaaaaatagggaagaaaccttcaagtttctacttacatttcctgaattaaatagtttacatccatagaagaaaataaatattcatgcaaagctatacaaattcctttgtaggtttttagtaactattctaacagaaatgtatttgtagctaaaaaatgaagtgttaagcatgttttaaaaacggagcattgattttctacagcagggatatttagagtcttctttcccctggttacactcatgtgcatttgcttaaatccagtggcctctggctgcacctgcctttgcatcatgactttgtccaatcctgcatgtgttaatttagggcccaagggaccagtctggagcacgcagccatcctgagtaattcacagtccattagacagcggtctgtggggtatgtgctgagtccacacactgatgttccaggaggttcttgcaacttccccaccttgcagctgcctctccagcaccttactctcagtccttccccacaactactctccatctttaacttattacactccctgtcttagtccctttgtgttgctataataaaatacctgagtctggataatttataaagcacagaaatttgttttctctcagtcctggggtctggaaagtctgaggtcgaagtgctggcatctggcaagggccatcttgctgtgtcctccatggcagaaggtggaagagaacgaaccttctcctgcaaccccatttttttaatacattaaatgcatttataagggtggagcctcatgatttgaacacctcccaaaaggccccaccccccaaacactgttgcattggggattaagtttccagcacataaattttggggggcacattcagaccatagtacctcccaaatctataaggccacctctactttgctctcagctctatctgttcatttgcaattgtcttttaaaccccacttaaatgtcctatcacattttatcaacaataacttacttcactgggcttccttacacacactagttcctattcctgacttctgatttttattaatatccctgttcttctagttatccatctttgacacttataatatctctttcatttactacatatagtaaagtgaccacattttgacaattctttctccagtgtaagtgtggtgtcctataactaatgcccttttcttcctatagccatcacttgcatcctccatgattggaacagtcccctggtgtgccccacacctgctgttctcctctccagcatctaatccgtcctacccactgccatcagatcactatggagagcccaggcctaatcatgtcaattccaggctatcagatgttcattgtcagtttaatcacagaattggctgaagtcctttatgctctaattattccatcatcctcaccctcttctcctacatgcaattgacactatgactaaatggggtacttgctcttcctccaaaaaagctctaaacgtttttgtttccttgcttctgtaaggcagttcctcaccctataaggggcccattctgtccctgaaattctcatccctcatatttatctcttgaaatactgtccattatttaaaatacaggtcccataccttctttttcacaagattttccaattttcttaacttgaagtcatagctctctccccctacctcctccttccccggtatacttggtaattctatattcacattattcacacacatgcatccaaacatttttcttatccttctactaaatatgaaatatcataagtagaagccactcctgcttcacggcagcagtctcctacataaccacagagtttagacttcactaaaatgtaagctttgtttttgtcaaggttgtatctgaatcagtgtctatatcagggcctgtaacctagcaggggtttcaagagtgctgatgcaatgaacagatgaatgaactcttgtgaagcaatagatctagcacccagattgatcccgtcttcttacaaacacatctttaggctgtccccctgtgtcttcttcaaagttgacactgatattcgtttaaattttatttcacctgaataaaaaaatatagtgtgagaatgatctgctgagagcccagctctccttaaaaaactctgcctcaaagatactttaaattatattcttgatgaaatttgtattcttcgtgatgtatcaacctcggcagcaaatgacaacaaaccacagctggttactgtttgaacccaaggttgtaaaccaaagagtgtgtgtgcatttctccccaccctaccccatacaacctacttcatcctcatgcatgtgtagataacaggtcaaccaaggctagaaatcataatgggtgtgagttctggttccagagttatatcacctcaatgatcttattcatttcattcctctacccttgcttgagtaaagctaatcattttctcatcttccccagatctctttggggttctaaaccaagctgaaaagtagaccacagttaatacgccctctttcccagccacccagtacatctcctgtctttagccagggaagcacctgtatgccccaattctggccaatcttggctaaggtgccaactctaacgattctagaagctgttggttaagtgtgttgcctgatcagggatacttccttacaatgagggagttatgaagaagctattggatcaataagctaatattatagaattacactatccagtactagatctggaagcaaccttataggtacatattctaactccttttataagtgaattaagtgacctctctggttgagtgatataagatctagtccaggctgtgccactaactcccaattcatgtgtatttcaccataccatctgcctttcctctagagtctccaaagaacaaagctacaatgagggaataaaaaagtagaattcacaatgttaagaaggcagttctctcaaaccataccacgtaacagcaactcctctgcctagccatggtgccaaccccatcaattttcaataaaacttcacctgtaatattcaaggagtagtggagtacgtgataatgcactagatttaaagttacccaagggctaatttttaaaaaatcatttttcatatccaatattaaattggttgttagttcttttctatatgtctgtgataacctttgtgccctggttagcagggtctagaaagagccatccatctcaacaacagtggatttagacttgcaggaaacatacagcttgagtgatttggctgtatctttaatgattcctgaacatctgccagaaagaagttgctcatttcaagtaagtcagtgatttaaacttatttttctgttttgtttctttctattaaaagtttctcctaaaattttaatttcatgagaaattctgattagttgggaagtaattttttttagttataatacaagtcaaaattaatattgacttaaggtataaattaagtttactcttgtagtgcctatgaaagactaaaattatgctgttcataaaatgtccctacagataagtttcacttaactggttttagaagatgcttttgggcctttttatttgccctaagcagacatttggactcccttaggtgaaatatgctccagcattagactgctttatttactttgagtttgtcttctcaatatgtgatttttagaaacttcaaaagtacaatgtcttttacatttataagtaaataattgagggaccagcctgcctggagcaaaggaatcagaaaacaagaaatctcagaatgactggtgacatggagtctgtgcttcactgcagttgctagaagtaaaccacagattgagctctgagcttcctaatagccatggcaaggagggaaagccattgaggtgctattcacagtagccactgataaaaacaaagcagccattcactagccatttcctgctagtgaaacataaggacagtttatcccatgagttcttttaagaaggaatgaagggctgggcgcggtggcttatgcctgtaatcccagcactttgggaggccgaggcgggtggatcacaaggtcaggaggtcgagaccatcctggctaacacggtgaaaccccgtctctactaaaaatacaaaaaattagccaggggtggtggcggatgcctgtagtctcagctacttggagagaggctgaggcaggagaatggcgtgaacccaggaggcagagcttgcagtaagcggagatagcaccactgcagtatggcccaggtgaaagagtgagactccgtctcaaaaaaaaaaaaaaaaaaaagaatgaagaaggcagatgcaatgtgacagagatttactagatgatgtgctcgataacacccttcaactagaaaaaaaaattagcttctcttagaatgtgctatcggcatatattggcatacagtaattaagtgtaattgagaaaaggtaattctgagagggaataaaagcaccagatgggagatacggcattcactcttacctaagtcctacctaccttcaagacctggatgaaacatcacttcctccaaggagtcgttgacagacttaggccacagtgatcattgctgcttccaaacatctatggcatttgttgaccaagctatttatgttatactataaggaagcgttgacaaaaacgtggcagttttggtatctgggcaacattccgcaggggctaggattgtgtcatttattgtagtaaatccaatgtctcattcatttcctgtcacccagtaggccctcaggtttgttgccatggatgagttaacagatggcactgactcttggtggcactggagactgcagccatcagatgatgtttcaagagacactccactgtgatgacacatcctgaagacagggaaactaatgtcctttgagaagtacaaatgtctatttttatttcacgtagtattggcttgaaaagatacaaattcacttaggatgaaataaaagtgttctgtatttgaactttatttcaaattattatttcttggaggtttttattaggcaaccagttcctcctgtcttagaaagatgtagggacggagaagttctaaaaattctgggcctatccttcaaggttcaatctcatagtttcttcctcaggaaaacctcctctggccatcctagcagatagacatggcacttccatgtctgtccaattcccccaaaacatgacctaaggctcatctggaataagcaatcttcttctgtgtaaatattttataactatagcctattataaactatttgtttagaaaaaagactggaaaagtacacaccagaatgtagggtgtgtattttcccttcaaactcatttacctttgcagccctcttgaataatgtccttccaagccttttgaataacttttatgttgttgaatatttaaatcgtctccaatagtggtaatttttacagtctacaaacaacaaaaggtaattcaatgtcaagaacaattaataagatagatattcagagtggttgatatggtgagatgaggtttggtttccaaaaaatggttgttctaaaaggaaaccaatcatgtctatgtatgttatatgaatgttgagctctgtttggagttacccccatcatgaaggtgccctcaaccatagcagtgtcactaaaataaatgacaaggcaattttttggaaggtaatattgtctctgaattaaaaaaatggaaaatctttatgcctctctctctctctctctctccatccaatgacactaatgactacttcaggatgtctgaatattgtacttgcttatatatgttcactgcaaccaccatggcaatgaaacatgacaggtcctatagtggaaatcatggcgtggtcctccaaggttaaattggagggaaaccccaccatgaaatgcagtggctagatgctagatcttcactccactccccactcaccagcactgcttctggctttgggattgagcttccttctgggtgaagctcagaagagctcaaacttttctgagccaaggtcaagctgggaaccttgttacgctattttatttttaaatattcacttcccattatgtctgagtcttcagccacatcttgtttatctggtgaacgagtaaataacacacagtttctatgtcagtttcattcatcccatgttttattgagcacctgctgtaagccaggcattcacctggtgatcacttaaggcccatctccttgcttccagcttgcttccctataatagaggatttttttattctctttgagtatgagtgcacagcacacacacacacacacacacacctgttttgtattcaaactgagaatgctcatttatacacagctctcctcttaagcacacaaaaattaaggcatccaacaatcagataaggcaaatgcatttatcaagcatccagcgacaaaaagctcctagacgtctactacatgcagcactgctgttcgggtgctggggttatagcaggctacaagggaggcaggtctgcgttcatgccacctacattttaataagaggagaaaagaatagagaagcactgggcagctgctgaggagtgctaaggagaaaaatcaagggaggaacaaagagtgatgaggagtgttgatttcagaagtgagatcatggaaggtcgccctgttgaagggacatgtgaaagagaacctgaagaaaggtccagcaccatcaggatgtctccacgaaggtgacagtgtcttgtctaggtctgccttgccaccgagtcaccgactgtgagaattggaaggaatatcagcatccttcatttaacagttaggaaaataagaccaaaaagaggttacagtccaagttcagcttcacaaagacgtatctctagatagaagggaaaaaaaggagagcaagaaaatgttaaaagttgactatgcttagaaactgccaaaaatatttaacaaaatgtgccagaactagctgaaaaataagttcctgaatattcaatcaaatattctatatttaatttcatggtataagaatgcagtaatcgaataaatccttgctcttctcagcaaccacttacattgttttataaagttgatccacatcctatctttaggttgtagaaaaggatgctgggggagctgtcatcccagacccttaaatgtagttaatcccctggtaccaagcaaagctcagaatcttcaggacatctgcctctactaccttatgctagaccttagtatctagggagaatgacagcaacatcgtggtcatggttctgaggaaagcagtggaatgcacatcagaggaaaccaactaaacactcacctgtaatgagatgggaagtgattacactatttttcttcatggtatttatagttttaaggaacagctccctgtaagtgacatctacccactgccctttatcctcctattaaagcttttgtaacagatggtgtttatagaattggctactctgactgttagcactgtgaagacatgagtctatgaagaatgtaccccaattttcattacaccccagactaaagtgctaagtagtgatcttttgaatgaatggaatcccattgatagagagtcaattatgcctttgcattaacacacatcatcttttgttcattaactcagaaactagagtgagctggcagcctgagagccaaagagcttctgtgagactctcaagtgacttaacgtggctggccgatgactgattccttccaggtgaagcgctaagccccatcatgcccctgttcagctatggcagggttccaagtgggcagcccagctctcctctgggaggagcattgggcaccacttgagttgagtttgtccaggacctgagctgtattgttctgtgatgtgggacaatcttctcgagcagtatcaatgcttctgagtcacaagggtcaaaagagagttatttccctggggctacaactttctgagtttgcacaacttccagatgcagaattaatttcctgaggtcatctgcagcatggtgcagataggtcacttaccctgcaagcagtatggaaacctgatatctagaattgttgactattctgtgaaacttgtttctcatatcttatttcttcataatatcttgccccatcacatcttcaaggctttgtttgaccttatgggcactgagtaactttttccttttctgaatgcatttggcgtttactgttgaaatctatggcttctttagtgagtacttgccgagtgctcactgtgttcctttgaatggaggtagagtcctatgaaggataagtccttaaggcaggggctatttttatagtttagtatctatctttaacttcagtttggctggagaactaagatacattaaaagaaacttggcagtggggggtggctcacgcctataatcccagcattttgggagaccaaggcaagtggatcgcctgagctcaagagtttgagactagcctgggcaacatggtgagatgctgtctctattaaaaatataaaaattagctgggcatggtggtatgtgcctgttgtcccagctaatttggagggtgaggtggtaggattgcttgagcccggggagggggaggttacagtgagccaagatcgcaccactgcactccagcctgggtgacaaagtgagacccccatctcaaagaaagaaagaaagaaagaaaaaaaaaactcaagctcctcaaaggtggaaaatttatatataagatagctggaaaaataagactaagtaaatttgctttgtaatgtttacaataccgtatgtgtttagtgtctggatgaagaatgaataggttccgggcatgataatattttctttgagcacaaatatgttttatgattgtcagaaccagtgtggaaaattactaaagaaactaaatattcttttgcaaatgcacagtattttgacattttcatttcaaatcaagatgctggaataaggattcccccaaaacctgtaaaactcagcgcagatcccagcaatagatggggttgtgtgtccttgctagctcattgcggattgggggccagctgcactgaggatggccttagctccctgtctgctgagagcaggatgaaatcaatgactgactgatgtctcctaagtgcctgatatatggttgctgatgcagagaggttctggtgacagcccacactgagggatgcttatggagggcccaagtaggcgagagaatgcaccctgcgtatgtatgtggaagccaaggatccagctggcaagttggcaccagccaggctgagtacagaggttccagtctctacatcagaagagccgagtttcctgacctagagaagttattttggctttcaagttttcatctttaataagaagggtttggaataaaagaaggaatactgacaatagctgacgtttcctggatacttatgggtgccagctgctcttcttcgcgtattcatctgtgcaatccaaacagcactctatggctagaggccactgcgacctctcttttctaggcataaacctgagtccctggcccagggtcacagctggcaggctgggcactgacggactccaggctttaagtcacattgctacactgtactcagggtatctgccgcccgggcccagacccagagatccaccctaagggcgaggataaggagacagaggacaggcagatgacaaggtgggggcagttctcatgaagggtttccttcttggacactgatttcttcccaggatgcctgaggatgctgaccagctccttccatccctgtcctcctcacctctttccacatcccctgcagatcagcccagcagtgaggcacagcctagggtcggatgtcccatagatcatcatggaagctcagaagcaatccgttcttcattttagaggctcctctccgtcaagattctggaaacacaggagaacactgtgacctttctcagaggatgttttcctaacatgcctgggaggaagacttgaatggtggtgtgaaaatgtcttttcatgccctaatcaatagcccatcaattatgtatgtacttatgtatgtaaaccctgttaccatcctgtggagaggataggacttggtgatgtccaactattgagctctttcttcaaagtcttaaaggaagttcagtacataaaaccatggcagcgggttggctctggcagagtggagtcagtcagacatctggagcgctgtcctcactctgcctccccaccctcgggcatgcttgttggaactgacagctccactgctggcagtttataaatctttccagtgttttcattgagggttgtcaaaatgttaaggcatattaggccatcatggagcaaggtaacctccaaggcctttacctcttctaaataatgctttattctcttttcttctggtcatgaagatacagttggaaattcctacagattggctttgcttgaaaggctattgtagaccattaatgggcgaaatccctgtatttgaaattgtaagatgcaatgagggaaggcaatccacgtgatttccttgtgttcccctagtggagtgaaaacagatactgacgattgtttcctcattcctggtggcatcttgagatggtttggtaacatccaagctgtgcagatgttaccacggagcatggaggcttttctgaactcctacaggtttcattgtctgtgccactttttggtacttaccatttacgtatttgaactgtgtattgtttcacaggtgtgtgttttccaagttgccactctaccaaccctttttgtatattcctgagttcaaaaagcactttaaggaaacaaactgacaaaaacatgcagtttaagaggaggaaacaggaagatggctcacatgtagcttgagtgaacaatcacatttagcacagtgcaggctttcagtcttttcatgtcatgcgtatttttgtatcctacggacaatgagccttgactgcttttttaggcctcttaccagcttcctcctctgaagtgtagtaagtagcttcctatataatataatttgtagatgactaaaagcaaggcctgatcccacatatctcttttatagacctgctacattgccagaaaggtcttcattgctcaaccttacacccctcaaggataaaagctttctcaaccacaagaattcctgcagaatttggctatgtctcattcattattgtacggggtcagtcgctggcccaatatctaggctatagtaggtatctctaaactattgggaaacctgtagtcatttggtggcttatttttcagtgagtgcagataggagatggaatatgggtggatctagatggatagagttggatcacaaagtgaaaaccatcacttggtgggaccatgttggggaggatcctgaggatgctgaggtcagtccatgacgtctgtgacaggcacatgagggaggggccatgtcatatgtgtctcaatttgccatctctgcttagagcctgagtgactgcttgagaaggtaggcccaagcccagaggacagagcatatgagggtggatttgactgagagagttggtaacacactttctaagtgagaaatacggatgacaggaacaccctgcctctgcccgtggcccagctctgcttgagtctgtcactgtctcctttcctggaaatgtcagtgtcgcttccctcatgcgttttggagccttgagttcaggctaaaacagggccttttgaggggaggagaaaaaaggaaagagggcaaaaggatgaagtgtgatttcttaaacaggtttttaagaaaggagaaaagggccttgcttaattttgagacttccaaaaggttaggctacatgtaaagggaaaggtgaggttgatgctggttttacaagaactgctttgctcagttctacttggttcttatcaacgtcggtgacccgcagaactccttacgaagcagtctagtggctacaggatagcatccaaagtgactgcttagagtttatgaatcttcactaatgtgtgtgtcccagataacaggatggaaggaaaaaaaatgaaacctgtgtagacactgagtatgttagtttggaacagtgaggaaagctttaagagagaaatcagtattatatcagtttagccaggctcacaatcaatagtcatttgataaaagctgagcgtgtgtgacactctcctaacacagagtcctgtgattctttggggatgtctttgctggtgtatcagatagctattgctatgcaagcaccccaagacttagtgggcttaagacagcatcatgttatgaaaatcatgcattttcatctttaataagaagggtttggaataaaagaaggaatactgactattccttctgaatattggatgatctggggtgtgcctcactgtgtgtcagctcactggcttgcttgcttctgcctgggaagtggccttgccaggggcatcttttctgagcagggctgctccatgcatctctccttctctgcctcctgggactgggaggcatggtccttgcatggccatgacaagcgcatgcaagctctcctgagacttaagctcagaacaggccctggaacttccccctcatttctgtggctccaaggaagccccatggccaaagaatggggaaataggctctatcccttttgcagaagtaactgcaatgtacacagactgtaagtaaagggaaccatgaagaattgaggccgttagtgcaattaacatgcttagattactcttaagctcttattgttgctattagtgatctctctggaccctggaaatgtccagcaaggctttaggatggtagctgtagtagaagcatgagtggatagtcatgacctgcttttatcctcactgtcaatgtttttctttccatacattgttgaggttaagtttgctgaatggtaaagaagtataatttttgaaattgttttctgtcgtcagttagtaaatcaatcaacatttactgcacagctactggaggagcagcacctgctacttcctgggttcatggagccataggggtgaggagggtgacatttactgagtaatcacttcgtgtcaggaactgtgccaagaacctcgtaaactccagattaattgagatagacattttggtggggagatatctatgcattgttttattgttagatcaggcataatatatccaaagtgtaaagtctttggaaactctcgatgaaggaaagggattcagtttccaaggtgtgggctagaatgcagaaaataaaaatgtgtaagtgaaggttttctgtggctttggtaatggctgtgtttttgatatatagtaaacaatgataaatcgttgttcttttaactctgaattttttttaaaagaatgtcactgtgcacggtttgaagctgcaaagattgccttcgagagggaggagtcatttctccacgtccctataacattatgtggaatgttgtctgtcagctttggactgtagtttatatgtcagtgactgtagtttatatggagtattttgtttaacttttcatttgttcccaatgttacaattttgctttctcatagatatgcatatggaaccaatgcactaataaggttcatttctcctaatatatgctgtctgtacatttgtcgcctataatagttgttaatggttttaaagagggtcatgatagtccgttatgtcaaaagatgccattgccttctgtctttttctgtgcattcctggttttgaaaatgagggtacaatcagacctgaaaaaaaaaagcatatgactttgtttcatgacctacaaaaagtaatggtaagcaagatgcaaattcttattctccaagggtatatacactgtcaaacaattgaaagaagccaagactatctgaaaaggcctatttttcagatttcatcttggagacctttcatcatagttcctaccccaagaaaataactaatttgctctagccttatggaatagcctggaatggctgcctgggccatctgagaagttggctggtcctatccagggcttccccagttggcctggctttgctcaggggccgggggctgaactttagcaggttccactagtgctgttgggagctccacagagaaaggtcgaacgcttggtggtttgtccttgtggtcagaccccgggatttgacttttaagaatactctgaaaatgaaaatggatttcctgggaaggaagtatgtgaagtcattaacattaattaatagcttatcgaaaaattaggctttcaggctggaagaaagtaggcaggcctgaagaagggagctcaggaaggagagctggagggaccacagcagggagctggcccagaggcaggtgacgtcgcccaggaggctggacctcggggattgtggttctgtcaagaaaggatggttgctggtgggggctggggggctgtgggggctgggggtgctggagcagggaggtgtgacccaccccagggaataggaggagagaagtgggtagggttttcttggactctcacttcaccttccggttggacgagctgcaagcatgagcttctaagctttgcatcccagagtgttggcggctatggagatcctgcgggcctcactgccgccattccccatggccactcagccagcactacctaggcactgagctccgtgagggacttttttcctgctcaccttatctcaatggggtcaggcgggctgaagcttctggagtcttggtgaggctgttgctggattgaatatgagcagctgcagggctggaggaacccaaatctcagtggagcctgttcattgaagaccttactgataggttagtgccaaggggtgctgacaggtacagttatggggaactggcacatacgaggtagcagcatctgccctgaccttggccctataatcatccgtggcattgttgagaacagataaacagtaaccaacagtgggctcacatcacagatgttttcccttggtgcttggtgggccccaagatgttggggttcaaggtttttattatgtctagggagggccagaatcagtcctatctgctcgcattgagatggcctttgttcaagcaagaggtgaaattaagtgtccagaggcagaaatagatttcactctgggttctgttatccatggttctttgtagattctttctgaatgtccacaggtgtgctcaactgctaaattcagctgcctttgaaatcacaaaaagggctcaacaagtggaggtctcttccaccagcaaagcaaaggattgtgtaattcgatcactagggtaggctctgaggctgcgtggcccgagttgaaagctgagctctgcacggacagctggtgggtctctgcctaagttattttacctatctgtgctctgcttcctctcctcaccagaaaaccgaggctatggttgtatttgcatcataaggttaccaagaaaatgcaataagctaatgtacagggagcacttaaaagactatctgcacgcaggaagccctcgataactaattgtttgctgtaattattaatggtcaccccacatataggtgaggaaatcttgaattgccctggttggtgctgctgggtatttggctcaggtaagagtggtatagcagcttggctttttttagatgagaagctacctccccctgaaagggggctgagtttttgtctcctacagctgctcccctgagaagatattcagctcttcccaaactactggttgtttagaaggtggctgtgtacagagcctggtcatgctatgggtcacagagacacagggccactgcctgcacccacctggacagcacccttctgtgtgacttccatggggaggactgtgagtggtgccccagtgttgggatagggaccagatgactgcagaggaaacaccattaacatttgtctattcagcaaacactttactctcacatgaatgtcgatgtatctttgggcttcttataaaagaatcccacattcactcaacgtctgtgagtatagacattgttatttgttcctttcactttttaaagtgaattaatttgtacaatagtggttttcaaagtttgttgttcttgaaaaatcaccgatcaagcattaaaaatgcacacactggggtctcacccctgagaagctgctctgcttggtcattcaggaaaactcaggtacctacattttaaaaaaaattctcagatgagctgccaggcaaaatcacctctaattgcttctcttgttttagttctcccaacaacctgtaagagaaaattggacagatattcctgtccccattttagatgaggccgcaagtacttagagtgaaaatttgtttgaggtcacataattagttaacatattattccagataatcacagatttcttttttagacaacgctccctacatctcaatagcttaaccaaagaatgtgtcagagggccatctttttgcatctctgggttctgcagggcctgctgcaggaattggtgtccacagggggttctggagccaattctccacagatagtgaggtagttctcctgtggtcacacacctcgggatccttcacagccaggtgtgtgggcagacgagagagtgtggtcatgctacagatagcctggcattgacgttcatcactttagcccgtattccgttggcctgaactgaggcataccatgccgtgaggctcagcgagatgcaacggagtgtgggcagtgtcctcccggatgttcagaagaaaaggaccctgctgaacacatgcagtagtttccaccactattaatgaccgtaaggcaatgaatctaaatagtgaaaatctttgcatgaaacctatgcttttactgacattgtattgttgcaacaatccagggatgtagttatgtatctccctattgtttaaggatgataaaacagattcagagaatttaagtgacttgcaaaagtccacacccctgagaaacaagagagccagagaacccgtgggcagctctcagctctggcgccagggctgtgtggttgggacatacccattgaccttggaggcagaacaaagctggtatcaaaactcagatttcttgactgccatttcagtgtactttttccactacaagatatttcttactgttttgagcatgctgtattaccacagggactagcgacataggtttaagcaagtcttcagtgactgaaggagaaaaacatgtagtaaatattgcttaaatcttttctcattaccacatagaaacacatttctatgtagaagtagaagacatttctacttacctatcctgagaaccttctctctgaaaagctcacagcagagtccatctctcccgcttggcagctgcaataagtacagtaattaggaatattatttcttttctttttttttttttttttttttgagacggagtctcgctctgtcgcccaggctggagtgcagtggcgcgatctcggctcactgcaagctccgcctcccaggttcacgccattctcctgcctcagcctcccgagtagctgggactacaggcgcccgccactacgcccggctaattttttttttgtatttttagtagagacggggtttcaccgtgttagccaggatggtctcgatctcctgacctcgtgatccgcccgcctcggcctcccaaagtgctgggattacaggcgtgagccaccgcgcccggccaggaatattatttctaactcacaagagttcttctgcatgttagccaccccccagagaaaatagtctccattgttgttctctcttcagcatatcccaggtatgtttccaagcaagttttgctccactataagttgatgaggacctttttttttggaagctgatggcctggcaagagttagtcttaataggttgtgtttcttctcactttagctggctctccctaatgataatgtctgttcaagttgagcccagtttcagccagtttctctgggagtcaaaagcctgtagcacacccagagagccaccacctgtccacagcatatggtctgaaggcatctctgctgctctagcctgaccagccagcccaggatttccaactgtgagctcaccctccttgtaaggcaaacagggtttagccagcgctcaccttgacctggtgacctttgaagattgaggttgcaggagaatgcaattgagaatgcagcgggtttccagaccccatgtgagccatccctgatgcttcaccctggctccatgggaaggaacccagagccctgcctggctggtctcctgctaatgagatggaaagcaggggtcctggccacaccatgaaactcatgatgttctccactcttgtgtccctgccatggctcacattcagtaattagataccagctcattaattcctgctattctttcagaagggaaaggatggtgccctttgttctgctctgctgggccctgagccctcacagcatgaagtagctagattctgcctcactccagaggcggctgccactttctcaccccacagtcagcccctcaaccatgaaaagatgtaaggatgtagctaaattacataacccaagcatgaaagcacctgacgtgtatgaaaccatgttctcagacacttgtaggcagtgacaactttataattaggcatttcatccaacttatgtatcttacatagggaaattgacatcttagcaaaatttatttgcctaaagtcgcataggtaattaaaagtagatacagctgagactagttgctataatgcccagctaggagggagtcggtggaagaggtgtcatctattttcctttgaaggtttgtaagtatttgacttttcctgccctgagactgacttgcctctgaggaggcccatccgacttagcttgaacaacccggattcttgtctttagtcaaaagcctctaaataaagaatacaaatcagcttaacttctccaaggtctggcaaagctttatacacctttcagaaacagaacacagcaaatctgcctcagcaaacatgtgcatacgactttcatctgagctatcaggaaggcatcttatagacacatacaacggaagcccagagggctctggcatgttgcaaaatcaaacagtccagaaaactttccaccccagaccactattcagttgtcatctgaaataatggaagtcagagtcaaactcatcaattaaacgagaattatttatttatcataatctctactgcctgctgcttcaaatgctttctcatgaattaatgagctcatctacgtgcatgtcaatattttgttttaaactacaaaataaaacacaggattaggttttgttctcagtgtctacctttctgtggcattgatgcagatagcaactaaggattaaatcacagaatggttccctttttaatttatttatagaaatgggcttttgcttttattagtgatgaatgaagagagcttgacttggggaaatttagactgagattattgaagtggcctagagtttggaaatttttataaaacccaactgtgcaagtggattgaaattgtgcttaagaacaggctttcatgccagacttgtgccgaattccatttggttcctggcagaaaacccttgaagaatggtatttggttttgtttatttggcatttcaaatactggttcatctggcccccatcctgatcaaaaatagtcagaagtagaaatgggtacttgagtggcagcagagtggattcatctgggcatggcagcacctagcgtaggtctccaatatgccattgagaatgttgttgagtgcaggataacctttaacataatacccctatccctctcctgtttccttgctggttgatcatctgccctgggccacaaatagctctccctctccactctcccaaggaagaaagtcctgacaaattactcccttaacccagctctgttcctgaaggcttgcatattccatcacagaacttcctcttgggatggagagtaatgttgggacagatgactgtcctactttctagcaatgaaaaatgattgcatgaagcctcacattcctgatgctaatgagaatctgtcctttcagctggcgtttgcatcaggagatgccactgcttgatttgtaatgttttgcactaacactctgagtgaaccctgtctttgggccgttccattgcacaataggcagttgaaatctatgcttttctcaatagggagtacaaaaaattcatcattttaaagtgggctgtcagatctaagaaataaatctcagttcataaacttgaaaaactcagaagtgttaaaaattttattcactaagaacataacatccaagacgagagatcaattttgcatattattatttctacctgaagtattccatctcacttaaaagaaatatttgtttggaagcattggttggtgctggtagccaaggctgtccaacaaaaaaagcgagtttttaaagaaaatgttattccctaagggtgaatcttaaaaaattgccaaatgtattcttgagatgaataacaggaagcttagttctagaaagggcctgagtgattatcgaatccattcttcatttcacagacgagaaaatgagtttcagagatgcaaacattcctactatcacagaactagtaagctggagaacagacattaagacctgtaatagtgattcccgtgtgaatgtttttatgatgaaactgtacaaaatgatagaacaataacaatgtcaaaacacctatcactaagcactttcatatgtaatatctttttttaattataacaaaatggcaaagtaggtgttatctccatttcacaaatggtacaactgaggctcagaaacattaagcaactgtcctggggtcacaaagaagacactattagagccaggtttagtccacatattcaatttctttgtttatttccttcactttgcatgagaattcctttttgctgtctttcatttttaagcagaaacctttctttaaagacactaatgatcaaagatctaaattaaaaactaaaactattaaatttctagaggaaatcatagccctacatctaatatataatagaaccagatggaaattctagaaaattctgaaaagtacaatatctgaaaaggaagacaatacttagcttggattaggcaatttgtttcttagatgtgacaccaaatgcacaaagaacaaagggaaaacaagataaattgggcatttttgaaattaaaaacttttgtgcatcaaacaccattaaggaaatgaaaagacaattcatagaatgggagaacacttttgcaaattgaatatctgacaagagacttgtatctggaatctattaagaatgctatataattcaataacaaactgacaagtaaccctattgaaaatgggagtaccaagtataccttttcatttaaatcattgaacagttcacaatggctgttgtaaagtttttgccttgttactgaaaccatcatctcttggtctatttctatggagttattttttcctagttattggcagtttgcttatcttttatgtgtctaataacttttaattgaatgtagaacattatggatcttatatttttgagaatctgaatgtttaaaattcctttgaagagtttgtgttttcttctggaggcagtttacttactggctgtgagctcagtcctgttgaggctgtttcacgacaggctgtggctttgtcagggtgggtgtggatcagacatctggtcatcaaccctgcatattccagcctctttcacaggctcactcgctgatttctgtttctcccacattaaggccactgctctctgatagtctctgcctctcccaggctggaaaacagccttaagcagagagcccttgcaagtgaggagccccctcatgcttcccccttcacctccagggtcatagtcctgtagcgtatgtaatccccttcctaaaaacacttgctttatatatttccctagttgtgtaattgtttatagtgagagaggaagcctggttactcatgactctattatgagaagaaccacaaatctctcctacttcattttaatcattcgatgttagatgtatttaaccactttgttgccatgtttaaatttttatggggagaagcccaaggtaaataataaaattaacaaaacttttagtccagtgtgtattcctcagagaaacctcaggtttcttttcttttttttttttttttaacaaattcaggtctttgttctagaagttaaaaaaaaacaacatacaaccaaatatagttaaaacaggaaaatctatttgtgtttacttcatatctttctgttgggtcagatgataatgtttagaaaaatactgtaacattcttactttatgtggacaaacctttagaggctggcctctctgtagaaggattgcacagggaaataattttgagcctactttcttgtctttatcttctatgttctcttctcagcttcctgtcttgattggcatggaacttgctctgctcctcatgtttctatttgtttaggaaattcactaggagtgtacaagggacagattgtcagctgtcatccaagtccctttcaaataaccccactatcctttgccttaggaagtctgagcctccatcagatcccggtcacattgtgagggaggagtgaccagccaccgagggccacctcctgctcttctttcctctctcccctttgcccttgaggtgccctcaactcccaggctctctaatcatgctcttcccagcccaggattgccctggccagtgcagctcttccttaggttctagaaccactacctaatacctaattccaatagggtccttttgactgaagctgacttaatgtgtttgagaaagcagggctaaaataaaaagaccctaatgtagcagaggccttgataaattctaccgaagtgatgagaactgtgggaatttctgactgagcccaaaagttattagaggcaagaatacttctctctccagtaaatgcctccccacctccacccccatttatagaaactttcaaatttatactagcataaggccaaccttatctgtgaccatgaataagctatttcactacctcgttgttctggtcaaaataatgcatggggctgggctcatgcctgtaatcccagcactttgggaggctgaggcaggtggatcacttgaggtcaggagttcgagaccaacctgcccaacatggtgaaaccccagctctactaaaaatacaaaaattaaccatgtgtggtggcacacgcgtgtagtcccagctacttgggaggctgaggcacgagaatcgcttattgcttgaacctgggagacggaggttgtagtgagccgagattttgccactgcactcgagcctgggtgacagagtgagactctgtgtcaaaaaaaaagaagaaagaaaaaagaaaaaaaaatcatgggctagctactctgcttgtattttttgtttctgtccatcctcttacttgatacccctccacgttctaaaaacaaagcctcccttcacattttgagtgtgtctgctatggataatgaggcagcaatcctggttctaaagaattgtgataaagcagtcactaaggatcccattaaaggtcaaaccatctaattcttaatctcacggcacctgcttgataatgatggatacttattaaactcattccttctgggtctcagaataccctttagaatgatccaatttttcattcaggcacttgaagttcattaaatgaatgctggagaaactgttttctcattgacgtacttgctttaatgaaatgagaaagtaagaagtgcctgaatattggtggtggttctcaaacccaaggaaatctaggggtttgtggagatccagaatctcctctctcctcaccacttttatggcctttatctaattttacttttcagccacgtttgatgtagctgacttccatctcgaaacactctcttctgattttccctttgattgcactatccactcctttttccatgtcctcgaccggttctgtcttcccgcgtgacctctcagcattgaagtcttatctgcctgccctcttctggatgcattgtattcctggatgagcttctcaatgccctagtctcatatactggccatatgatgaggattcctggttttacatgtcaagccttgtctccgtaagtgaactgcaaactcagttttcaaagtgcccatctgaccactccactctgatgtctaacatgtgctcgcttacatgtggccagaagagagctcctcatccccatggccatcgctcctccaccagtgttccatctcagtaaatggcaccaccaccaacccaggtgctcaagccacaagccctggagttgtcgttcgttcactttccatttcacctcatctaaccattcagcaagcctcatcgatcccatctccaaaatatacccctaatccatgcagtacacccacctccccactggggctgcaccagtccagccccagccactgttgtctctcactggaatctctgaagtcactcccaagaggtccctgcttccactccccctcccacacccattctccctaagacagccacagggatcctgttgaaacaagtcagatccatcaccccctggagtacctggcctcctttgcacatctcagaccgaagctccttactgacctctaatggtgtgcacgccctgttcctcggcccttataagaccccttttccctgcacactccatgctctggccatatcggcccacgttctattcctcgaatatatcacattccttctgcatcagtgcctttgctcctctgccccgaaggctctctcatagatcttcccgccattcaagtcagccccatgatacctccgcagtgacgcattccttgaccactctacctaaaatctctctccccccgccacacaatctctttgtcttgttttatcttcttctcaacacgtatcactatcaagacattgaacaaggaaatactgacggattttcatttcagtttcccccttagagaaggacattgtctattgttttttgctatatctgcaatgtgcttggtagttaggaagcattatataacaattttaaaaatggaaacattcagtttttaaagtaggtttattttttttttttttcagagaagccaagtaactggtatgcgtagtaataaaacatctcaataaagaattacaagacttgaggatctgggcatggtggctcacacatgtaatcccagcactttgtgaggctgaggtgggaggattgcttgagcccaggaattcgagaccagcttgggaaacatagcaagaccccaagtctacaaaggtttttggaaaaaaattagctgggtgtgcagatatatcttcaacatactgatttgctctattttggatatatacccagctgagagattgatcatttggtagttttagattttgggggaactttcatactgttttccacactggctgtactaatttaattcccaccaacagtgcacaagtgtttccctttctacacatcctctccaataaaagccacttcattttgagccattagtgaactgagagaaaacagcactatggagggagaaagtggattgtttccaagaagtaggtgggcaaggagcaatgaaggaaagataataccaaggcaaatacctggaggatgttaagccaagagcatcagaggagaaaaggaatcatcaagaggttggttagtgggtacaaacgtgcagttagaaggaataagtaatagtgttccacagcacagtagggtgactatagttaacaatatatgttttttttgagacagggtctcactctgtcacctaggtgggagtgaagtggtgcaatcatgtctcactgcagcctcaacctcctaaacacaagtgttcctcttgcctcagcctcccgagtaactgggaccacagcatgtgcccaccaagcccagctaattttttgagtttttgtagagatggggtttcactgtgttgccctggctgagcttgaactcctgggttctaagtgattgtccctcctcgacctcccaaagtgctgggattacagatgggattacagactgagccaccgtgcccagtcaacaataatttattgtatatttcaaaatatctagaggaggctgggcatggtggctcacacttataatcccagcactttgggaggctgaggattgtttgaggtcaggagtttgagaccagcctggacaacatagtacgggcctgtctctacaaaaaaagaaaattcaaaaacttagttgggcatggtggtatgtgcctgtagtcccagctactcaggaggctgaggcatgaagattgcttgagcccggaattttaaggttgcagtgagctatgatggcaccactgcactccagcctgggtgacagagtgagcccttgtcctaaaaaaaataaaaaaaaaataaaaaaataaaaaaaaaaaaaagaaaaatataaagaaagaattagaatacttgaaacctagccaaaaccttatccttacttagggtgatcctgtgcttccatttgctaatccatagatactcctaatatcttccttctcttcttcataagtgaggagataagatgaaataaggaattcgtaaatacaaagagagtcataaagcatcacataaatgttatgtttattttatattgaaatgtccacctgaaaaactttctctggcagagtgcagggccagatgaaattcacatgaaggaggaacacctgatctgtatggccctgtcattattatgcatacccatggaaccagctgggcactcagggttatatgtggtagccacagcagggtgatttgcaacccccactcctatatccatcaagacaaggccaccacgaggccccctatcctgctgtagatgacctgaaatacgctgtccccttagaggttgctttctttggaattgatcatgaacatctgtttggtttattgcagaacccacagaggccaacacagtgcctggcacattctaattgctcaatgatcttgagatcaataagggggtgaaaaatggctgctggtgtaaaaagcaggagaaaggcactgaaaggggatgagagtggacaccggagaccattttttgcccatttgttagtatttcatccactctgcaactagtctcccagtcattcctttatttttcccctgtatgagttgaagacgactctttgtggagtctaggaacaggcaagtgtccctatatatggaaaggaaggaacagttcacaagctttctaagctcacaacccagcttgtctgggcttttcaatagagtggttgccatgacattacataggagagcctttcaggcagttcccattgctaagggcaaagggtgactgtgatattaaaagaagcatttgttgctctttatactcagaggaaatcaaggtgaacttgaactcattaaaagcaaggctgagcacatttgcatgagcagaatgtaaatacaggaggcttcttgcagatgagcttctctcttgcagaagaagagacccagggcctcctgagcctgtttgttcttaattaagagagatccttttgggatgagagtgagtttgtaatggcatttctaccacaatgtacaacttctcaaatatctccttcccccatatcttcaaagttttaagtacagcccttagtgcaagtttgtaggggaaatatggaaaaatgcaaaacaaatacaataaacagagaaaacaatttaaaatgattctacacacaaatgaataatttaaacctccatcatgtttgctatctgtgatgcatctatttaatattaataacttgtgaagaaaaatgactgtcaccatttttaacaagcctagtctattctggctacaaaccttagatgactgactattcctaacagggccctgcttattaagagtctgttatcttctttaaatttaatttcatgaataatgaaatgtttataagaggaaaacaaatatcctgtctaaagccagcctctccttactcccttccacctctgtcaaatatttatctgcctctaccttcttcctttttcttttcttttctcttttctctcttctctttctatttcttctttctttctcccttccttcccttttttctttatctatctatttcttcctctctctcttccttccctccttccctcccttcctccctccctatctctctatccctctccctttctttcttttcttagttttcaacaccaggctccatatttaatgcacacagtgtaactagcttcaatagctgatcattctttctccagagatgtcttattacgaagcaaggagcacatacaaagcagttgtattgcttttcaaattccctcttcagtgaacatagtcattaaagaattgtatcaagaagaaacacttttataatgtggctgtccccaaattctaaagatggtgttattattgatttagtaatagcttacaaatcatgacccaaaattagttcttctgcacttatgccccaacctttgtaaaatctttattgaacaaccatggccagtaaccataacagataatgttctattaagtgcagtttttccatgggtcatataaagtctttttcttggagctcatataagagtccatggaaccttcattcactttggtgtctgcagggaactcttttcctgtggagtctgagtgatcacgtggaatctcaccccatgctgcccacagaactgtccatctaggtgtctcttgctgaccagactctgggtgtacagcagagctgacagcccaggtttcaaataaaactttccagaatttcacacacacacaaacacacacacacacacactcatacagcagctctgctgtctaagatgtcaagatgtcgttttgggttttatttgtttacattctgaattctgtgtccatgtgttttaaattttcctctagataaaagcgtgatagagcatctctgtggggaattgctgtgaagaagtcccactgtgggatgtggtgcagggtgaagatgcagatgagagaaggaaggagaaagctcagggagagggaagtagaaagaaggggaagaataaacggttggagaagctgcctgatgactttgagcttttgtagatcagcggatccaaacctcttgttgtgcaggaagtgttagagaacattaaaagattagcctagagtctcaggtagttcaagagtcagagttgggaccaggtcttctggttctgatccagagctttttctcctacttagctgtcattcccatgccattcatgtcatgttttaagcagttcagcaagcattcttgccgtgctgacttgtctctagcatgatgttcaagctctgaaaattgcaagtgaatttaaatagcctctgacctcagtgagctcaaattctcactgtggagatgacctccagccccaaaacagatcagagacctgctatgtaacacatggggcaagtgcaagagtgaaaggaggaggatttggggatctagaaaggtctggggcaaagcggcaagagaaacatgaggcatttaggggtgaacttggtggaagggggaaggcagagctgggaaaagggcaagactccttggtgaccaaatgggtagacatgtgacaaatcactgcccccattgtggaggatacaatgtggaaagagctgtgagcctctccccaggaagctgtggtccacatggatgatgatggggagatgtgggaaacgccaggcagagaggaagagagctgccggggaatagcatcattccaccaacggaggaccacagggcttggtgtaacacccacatgcagagggtaagacgaggacccatcccatcatcagcggtgccaacgcttacattgcagcaccttaccactcagagtgaggcttcagcactctgcgaacgtttgctgctgttattcattgatcacccatgcacctcacaacagccgtgcgagactgattgggctgtcaccactttctccatttagtggacgaggacaggaagtcacaaaatgggcctgagatcttagagtttgccaagtcctgcagccatatgtaagtttccctgatgccggtactcaggggtgctgtgctacttcagtgtctgctcctcccagagtgctgtagcccaggagaagaggcctttgtgccatgctttttacagcagcacctccagaagtcacgtaagagacctggcacttccagaatcctttccagcctacaaccattttcacataaaaatgggaaaaatggaggcagaggaaaccatatatcccaaacgagggccagttatcccctgtgtatgtggggctgaaggctcatgatgcagtgaaggaccaccatttccctccttccagtgtattaagaagacatctgggtgttccagttccatcagctcactcatccttcagtagagacaagtgagcttggcacgtggatatgtgaagtgctgtgtgcattcagcctcagtctcctatggtgtcccagctcctggactctaagcctccctgtttcatttatcaaagagattggatgacacccacctatgttggtgagaatggatcttcttcatctacccattcaaatgctcatcttttctagaaacaccctcatggacacaatccagaaataatgtcctaccagctatctgggcatcccattggccggtcaagttgatatccagaattcgctatctcagctgttaaggccaactcagatctaaggggaggagaattcaactccccctctcaatgggaggaatcctagaactgctagagtttcctgccaaccaacattcttaccaagtaaaataaaacaagaataaactttacattcggctacagaaggtgatggaagaggtagagcaagaggatctacaaagatgctaatttcatttataattattttgtgatggaaaaagtaataaattattatgagttgtcaccagactctttcttaaccagagaattctctttctttggaaaaatattttgaaaagctgcttgaccatggcaagtgagacattgaggacccaagcaacagatagatggtttatggcatgctgagtggagagtaggggacacttgcatttgcctttgggagggaaggagagaggaagaaatagaaaaaaaaggggaagaaactggagaatgtgaaagatgtgaagcatcatgggaaagtagaggccgggaaaaacatcctagtgataaaggtagaagaaaagagttttaggcaatgcctaatatgtgattgaaagatgcatgtcccccttcctgccatggatgctcccccctgaaattttaaggcaaattttatagactaacggttgccctgtgcaagtgttgtcttgtgtgtatgtgtggagtgtgaagttggggttgcagctgaattgcacctccagttcatcatgacttcgtatctcattgcatagtctggaaaaaggacaggcatagacaaaggaactcaccagcagaggtggccagaagaagaaatctttcctggcaattgaaagaaatcttagtgcagattgtggtcttgcactaggatgagacagaggttggagcttgtcttcctcagacatcaaagagcggggagaacccaactgccaactggtttgcatgtggcttgtggtttgacagctgactctttcttaacttctaatccaagggtcagtacaaagccaattccccttctcctccaggaggaagaaccttctacagcctgaggtacccagtacttgtcctgagtgtaagctaggatgacctctggatccatcatgctatatttagtctctgtttcacctaacactcaggattccatgaatgtacctttagtgagtccaggacaccttgtgaagattgcacgaaccctgcctgggaagtgacaaaggtgcagacttacccttggcatcttttgtacctttaaccacagagttcacatggagttgtgaccccagctcatgtaacctaatgcaaggtgaataatacctcctacagcaggctctggaaatgtttcttgtctgcacacacacacacacacacacacacacacacacacacacacacttcttaagtctgcattccccaaataataataaggggcatgttgctctataacaatcagcatcacgaaagcctacaggactttgccattcggtttaatggaattggtatatttgaaatactgcctttggaatttttttttgacagagtttcactcttgttgcccaggctggagtccaatggtacgatctcagctcattgcaacctccgcctcctgggttcaagtgattctcctgcctcagcctcccaagtagctggaattacaggtgcctaccaccatgctcggctaattttttgtattttaatacagacagggtttcaccatgttggccaggctggtctcgaactcctgatctcaggtgattcgctcgccttggcctcccaaagtgctgggattacaggtgtgaaccactgcctctggtctgcctttagatattttacataacagattgtattacaaagacctacacgcctccaaaaatactttggaatgttttaattatgcaaaaattgagaaaatagttaggaaagatgcatctgtctctgttaagaataaattcaattattagaatttaggggtgcccaacagcttacctgcagcaagattaggttgagttctactaccttcaaatgcttacctatgacctttgaagttctgattattctgggagcttctggtgctacatccactcaatctgccaggagaggaatttatcctacaggctgcataatttccttctcagctgtaaaatatctctttataagaggtgtgggcgagaaggaattatgggagcaaatacagtatttatcacttgaattaaacgactaaacctggcaaatagttcagctatcgatccacaaatagtatcaatccacaaattagcagcctgattcagataatctgatcagtagatatagttatatgtgagcatcataagcatcaaagccacttttatgtgtattatttttcttgtcacccacaaatcatgttgcaaagattgatagtaattgaataaattgccatgtgtacttaaagactgggcttgttggagacacaacacatttattagatgatcagttttttttttcctgttatgtcaatgctcactggaacacttcttttcaaatgtaggaaaaccaagctaactagatctagaaaaacaagcagaggtttcaagggatgcctttgaaaggtggtgtggtatcagggagcacgttgaattggaagtcagatgtccatgtgtggattcctttcatggcactccctgattgagacaatctgtaaaatccctttaacgtgcgtatgttatgattgcataatgtaattcttgtttagggtttattgtgtgactctttgctaagtaactgtactgtcataaatggagtccgagcagcggggcttgtctccccgtgagtgtgagatctgcatgctgccacctttctcctcctacttttctcgccaggtaccacagtctgtgtaagatgcaccaggctgatattttgtaaaatcaaggtcttcaccttccatttatgtggcacgagctggaatttgccagggtcaaatagtcaaccaggagttctttatggattcagccacatgggagaacttgagggaccttgcatgtcttatattctccaaaactccatccccacaggcttgccagtgtccaaaaggcctgatttttgggggaggaggcagctctaaaatagtgtcaattctagaactccttttttaaatgtcccaggaggagtaactattggcatcatcagtatttaaaactttgggctaattacatcacctgattatttccctcctttgtgctttctagagggatataaaccaatgagagtcttgagaggtggagtcagttcagctcagaagacactatcttgagggaaaaggccatgatgagtgggtttgtatgttgaattggaaagaggagaagggagatgaagagaaatagggtagggggagtactgagaggaaggatctgaagggtgatagagagaatgctgcctttggttaaaatttcaccagtgtagactgtgtttatgtagcttagtcagaatctcccttcatcctgtagtgctatgtttttgtttatttatgcaatactcttcctgtcaactatcacaattaagaatccctagtgtagcacagttatgaatgtggctgacctttcttaaaataatgtcctcgagctctgtagcactttaaacatttcaactcttttgcatatttggtttttcataatgtaggttgtaacacgatagaaggttagggaattaattgagtgggccatgatcagcttaagaaaataaaatgcaatagaaatatacctagtgcataataactagtagaatgaactaatatgaaactttgtccattatctatgtatgtagtatgtgtttactgtattgctatataaaatatatttctcatagtagattgcagtcacaaaagtttgaaagcctttgaaccccctttgaccatggaaaggaagagggattctgtacaggaaatggttaactcagcaggcctgggttgctcaaaccgtgcacattctcagaaagacctgctttgggactggcccttggatggtcctgggaaattagccaccaacctttggaatagtgtgcccaataagaatttttttggatgccttaggcttcagcccacatgaaaccagtttgatgactttatcctaacaatgtaatttatgtatggtgaatgcctgcttttgctttggggtggtgtgaggatctgaggtcaggtacgcaggtgccacatgcctgcatgactaacccccagtaagaaccctggacgccaagccatgggtgagcgtccgtggttggtaacatggtttctgggaaaattaatagagcccgtgagactccactagcaaagaacacctggaagctttcacctggtttctcctggactctgccccatgtaccttttattttattctgatttgaactcatatccttttgctgtaatatatcagaacagtacatctaattcagaaaagtaagcttttctgagtcctgtgaatcctagtgaatcatcaagctttagagtagtctcagggaacctggcgcagatgcagagattagacttgagacctagagaagttaagggctttctagaacatgtagctcaagcctgggcctggagtgtgatgaggtcatggacattaagctggaatgaaggtctgtaccaactcagtccttttctggtgaggcagcatggaaagacattggccttttctccatctgtgatgacagtgatccctggacgtgacttcttcaagtgtccttagtgagtttaactgggtaagagcaaaagaaatgaaatattttattcctttctcagtcccccatcaaggacatcaatagcataaaactgctataaaataacaaagcttattataaactttgcctccaaaagtggttctagcctttctgtaatctttcatatgagcttgttgttctgttgatcaatgaattcggtaatattctatttttaaaattattttaattatgatataaacaaatgagatacctcttcagagtccacatgaatggaaatgaatataaaatcagaatccaacacataaaaagaaagttcagcaaatgcaggactccagtctccactgcttcacagtagggtttgtccttgtgttttcttgttttgtttgggaaaataatgcaaaagagatttgttgtaaaagctttgaaatttaattatgatcagggagttctaaaggaaattaaacatagcatgagtacttttaaaaaatatgaatttaatatagcatcttatcaaataattcatcccacacggctagctcacttcccaccaggaaatagaaaagaatttttgaggactcttaactaataataatttctgaatttctctgacaccttcactgtttctaaacattttttttggtcatgttaacttacttgattcttcagagtttgcttattatagccatcactttctaatagtacatagtttgaaaagcacttggccgtcttctgcattctgggaacatgtggcttcctgacccacagaggatggcttctcgctgtgtcctcatgtggtggaaggggtgaggggtctctctgaagtgtctctgctaagggcgctagtcccattcttgtgggctttattctcaccacctaatcactcccaaagtccacctcctaacaccatcgcttcaggggaaaaatttcaaagtatgaatttggggagggggcggcattaaatagtcgatgccactccccatgctttcttttcctctgttgtggttttcagatgaacagagacttctggagttgatttgctgtcttatttgttctccctgcttgttctcgctcatctgggcaggtggtttgtcccttcttccccttatccaaatgataaattcctctccctcctctcctttcctcttccagtatcttccttcagctcctcctcttaggagctcaggaaatctgtctgcacctatcatactgacagcatgagcccaaatgtttttccgtagttcatcctggatcccggaaacatgggtggctgcctgcctgccagcctcagtttatttcccagccttactggtttgtaagctttaattttagaaaagaggacagagccatgcagtccacagaccactgcatggtgcttcgtcaccaccggccggtgctcccatgggctgcccaggtgcccaggcgtcctgggtccccaccctcgcatggctgtggagccgggacagctatgacatttgtgtggggttcttaaaaatgtgagaagctcctaatatgttgttgttaaactcatcctctctgatagaatttaattttaaacacaattcccccgaatacaccctaatgtgcttgtttcatttctggagactgtatgcatcactttccttgtctggccaaggccacaacagcgtttgcgttagccactgtgtccctgagtagatggggccctgtttactcttggcctgctccgtgggatcccagcccggccctactggacctcccagctcttttacaagtaacgccttctttcccaggtagccccattttctcctccttcatgacacgcctgtgggtccctgctttcctgggactgtcatcgatgtgcacgctggtgcctatgcacatgctccccctgcatcctcctcggtggggctgacacgcagggacttgcccacatcttctcatcttgatagaaaggatccctgtggcaagccctcttcctttcttcacaaagctgcgttcctcctttcccctctcctttggatatctgccctgaagaagctgatagaagcagatactgcttctggtaggccccgctctgcctgctccgatctttcacttctgcccactccatgctatggccttctctgtctcttcccttgttaactccctcgtctgcatccaattcctgatgcctctgacccctgacactgtgtgctgcccgcagccagaggaaaccacgttctggagtttggcagacctgaaatgcccacaactctggccttacttatgggaggcccttttcttcctcttccaagctctgagcagctccgaccacaccatcctcacactgccacctcccctctgtcctcgaggcccacagtcctgcaggtgcctctgagagtccggcacggtggggagtccacagggctactgtcacacccatactaacctagggagcctgtctctgaaacactgccacatacttgttttctcccatgttccatgtttccgatttaaatgagagacatgaccatttctatctggctctatgtccatgtcttccttgagacagtgcagtggtggattagaaattgtcttatgtcagctgggcacagtggctcacacctgtaatcccagcactttgggaggctgaggcgggtggatcacgaggtcaggagatcgagaccatcctggctaacatggtgaaaccccgtctctactaaaaatacaaaaaaaatagctgggcgcggtggcgggcgcctgtagtcccagctacttgggaggctgaagcaggagcatggcgtgaacctgggaggcagagcttgcagtgagctgagatcgcaccactgtactccagcctgggtgactgagcgagactccatctcaaacaaaaaaagaaagaaattgccttatgtcaaaaattagcaattttatgctgggcatggtggctcacgcctgtaatcccagcactttgggaggctgaggtaggtggatcatgaggtcaggagatcgagaccatcctggctaacatggtgaaaccctgtctttactaaaaatgcaaaaaattagttgggcatggtggcgggcgcctgtagtcccagctactcgggaggctgaggcaggagaatggcgtgaacccgggaggcagagcttgcagtgagctgagatcacgccactacactccaacctgggtgacagagcgaaactccatctcaaaaaaaaaaagtaaagaaaaaagaaaaaaagaaaaaaattgccttatgtcaaaaattagcaattttaggccaggcacggtggctcacgcctgtaatcccagcactttgggaagctgaggggggcagatcacttgaggccaggtgtttgaaaccagcctgggcaacatggcaaaaccccatctctactaaaaatacaagaattagccaggcgtggcggcgcacacctgtagttccaagtactcaggagattgcagtgggaggatcactccagctcaagaggttaaggctgaagtgagccatgttagcaccaccgcattccagcctgagtgacagagcaagaccctgtctaaaagaaattaaataagtagcaattttggcccctggctatttctctgcccctgacctatgtttttctgaaatgttatagacatcttccaaactgatttcacctaaatatcagaaatcgctcatcatggttcctttgtccagtgctgtggaaggccccagaggaggcttctgtggggtggtgagggcaccaggtgtgagttgggacctgagacctggtccttgttcttacagccgtgatgctgatgattaggaggccctcccagagcctccagacaggcttacaccatctggagcatgggcctgggtgaggcctcgtgagctcctgcatcataacggtgcttcctgctgctccaaagctgtggaatgtgtggtctgggaacagccctggctgaggtgagcgcatctttgcttgccttccacgtgacagacctggacctcagttcttgggaaggcgtccacgttcctttcccagcttccccattggatctgacgctctcctcttgtgatacctttacctgaattgctgggagattcagcgtctggacttccccactcccagccataggaaaaccttccccccagaagtccctggtgaccactcacacagcctgatctgctgccaacatctaccccttctggaagcagctgtcactgtttccagcgtgccagcctgacatatttcagagtgtctgcatgtctctgagctattaatacacaaaataacgtaagccccctcttctggactccccagtgtgtctgagaatgcctagtaagcatccatctggttacttttagctctaaacgttggttactagctcagcccaccaagagctcacatgcccaagctctccctggttgtcttatcctccctggctattacctctccctggctattatctcttactgaccattatcccccagggcgaatacaatcccttcttcttcacactgaaagccaccactaacacaatgatgatgtgtgtttaatgagtttcacccgctgaagttttagataaactatttttttaattctaatcttgcaaacaaggcttctgtgttcctctggtttctgggtcttcctcatgccaagaggccctccctaacaccttagccccagacctcttctgtcatctcagactctaaagcaaggtttcttaacgtggggtcccaggggcctgtgaacttaaagaaacaaaaaggtcataattatttttattaaagtctcactaaaaaactgctgcccttcagcatgtctgtaggcaaaatacacagtagttttggcattacctgtgactaaaaaaaatcacagatattcccatatcacagtggcaattgcagatatcttgaaatacaacatactctcaccattatttcaaagtcatagtaggttttaggcatacccctatttgataagctttgagactctaggcagacactcaagcaacagagctggtcagtctctggagattcccttctcaagagtcattcaggggcacgacctaaaggaacgagctttagagtgcagtttaactcaacagcctttggagaatctagcatttctggagtccaggctgtcttttccttacaaagtaaattatcaaatttgcattgtttatcattgggtatccttgctaaacaggagtctcattcttttttccttttttttgttttttttttttttttgggggacggggtctcgctctgtcacccaggctggagcgcagtggcacaatctcggctcactgcaagctctgcctcctggcttcatgccattctcctgcctcagcctcccgagtagctgggactacaggtgcccgccatcacacccgcctattttttttttttttttgtatttttagtagagacggggtttcaccgtgttagccaggatggatggtctcgatctcctgaccttgtgatcctcccgcctcagcctcccaaagtgctgggattacaggcatgagcaggagtcccattcttataagcatcagaattaaaaactcaaaattggatatctgatttgacaggcaagtcaagggagtgagctaggcagataactgggacaaggacgttgcaggtggaggtcagctggcataaacaacctgaagcaccgagtgttgctgagaaagagcaaggaagcctgtgtggctggggcctgaatgaaggaatgggaaggaaattagcttagagaggtagcaaagcgtatttatccttgtataccgttgggagcactgattttattttatttaaagcatgccttcttgtccaagacaattccccagtaaaatgttactagtttatctaagcccagacagccatttccctgatgtatctttaaaaataaaaaatctaactcctgtgttttaaatacattgtgaatcattaataaagcaatataaatacattttatttttgtatatttataactatgtttcaaaataatgcattttctttgcaatctgacatattttatcttatatatttaaacagaagattctgacaaatgaaatgctggcatcaccagattgttctaggagttcattttttttctgtctcatttttgtctaaagagacaaaaaagatctagaaccttttctaaattttagggcctgaatcccctctctctttaaaatgtgtccgcaccccccaccgaccccatcccccatccccccctacccccttgttgtgtggggcaattcagccttttcaggtggctttatatacctgtgactgcctttaaaggtggctttatatacctgtggctgcctttgaaggtggctttatatacctgtggctgcctttgaaggtggctttatacacctgtagctctggggccttccaagctaagcaacagtactgctaaacagttaagtctacatagttcctgggtggtaagtgatttccctgtattatttcacaaaatcataaaagcatttatttgcccagtaccccacaagtgatagaatctgagtccagaggttcggccaccagggctccagggcctgaggttttactgtgttgtgtgctgtggatgggttactatatcctttgacataaatatatacatacttggcttatgtctgctttgtccccagaatgcacacatatctgtggttaagacagtgttccttctttctttctctctcttttcctttctttgcccctctgcactggcattgaactctggggagaagacacttgcgttctgaggctgtttctctgtctctaaatgaagacagtcaaactgaatcgtttccaagtccccgtccagcatttaaattcagtgtaagaaggaactcctggctacgctgccttcctaacctggtcaaggaatgttcattctttgtattgactgcagtgtcattgaatttgctgcaaggctttacatcctcctcatgaagaggtgaccttgtatctagagtcccttcgtctctgtctttgatgcagtgatatttctcattgtgagtgattccataagctagaccagcagttgcccatattccatggttgattagttttctagaaaagaagaggacccttcacaatcacagttcttgtttggaaacccaacaggaccttaacatgtattcaaagtgctgataccaaatgcctcttcttacttggtgcccactcctctgcacacaagaacaagtgtttttttcttacaaataaccacttttcagttcattctagtatcacatggtttctagacttctttgcaatttgagtggaactaaactacagttcattgacaggcatcacacagcacgtgtttatagagattaacagaatatctctgccctggtgacattggtagaaggctcattgagatgattttactgtgaacgacgtgaatgccactattctagtaatagtgttcacagctgtatcaatttatggcttattaagtgtagggccaactaaataacacatatttttctacacaactgttgtcaagctgaatttgttccttctaggaaatagtacaacctaatttttcatctaaagatagaggtatacctggtcaaatccttcatagcaagaaagatactactgctagtatgaatcttgacttagaagatgaaagaagctcaaatgttcagttgttccaatcctttgaatttatagctgagggaatggaagtccatcaggagggcatgaagcctgttcaagttcacacagaggatgtggagcctctgatgctcatcgctgtggatccttcccatgcctttatcccccctctgcacacctcacatagtgtcatgagttcctgttctagagctgtggtcccctgaagcaaatctacgggtctcccttctcctgtcttttccttcctttgtgtgtgtgtatgtgcgtgtatgtttgagatcaatgatttctcttttgcctacttttgacttaagataacatttgttttggagctcgacaagcatgactcagcagtgtaacactctttttaattttaattattattattttatggttattcttttgtgattatcaagttgttcttgatgatatctgggcactgtgcaagacttccttcactgcatgggagtatgtgaggttcatttcaattgcacttgtgtttccatcttcttcccttctatcactgactcactcaaagcttgcttttgtttcataaaggatcaaccaacagaaaattgagaaagtcagtccattaatttgtttggccagttttagtcattggttggattcaaaataccccatctattcaacccagatggaaagaactgaccttttctgaagctaaaacatatgcaaaatggacaaagcccatggcttgacctgacctattcctaggtcatggtatcctgatagagcattctccccatccgaccctgaggcacctgaacccagcaacctctttatgcactcacattttcagccttaagggtcttccctaagctccgctttctgagggtaaagcctttaactttcctttgtggacaaattgctcactagctcatcattggggttcagtggacaaggtatccttacatgccatctcttcatgagggcgtgaaggctccgttcgtaaagaactatgatgtggtcatgtaatgggttcactttaagacttgaaaataagtaaagcgaataagttacactataattcatcatctttcatatatagcagtaatgcaataatacaataattactttggtttttgttggtaaattatataaatcattctattcattagagataatgaaaaagtaacacaaacatgatgtgatgtctcccttatgctactgatttactttatttcagtcccgcctcacttcagaatgcaattttttccttgcaggaattacttgtaatggcagtggtagaaccaggggatcaagatatccagcttctgatgcaggaaatccatctctctttattgatagcccagcatcatgcttttatctagagaggcatttatccatctaaacacccctagaaaagctatgtggaaaatgtaaaagcatcaggaagctcaaagttacagccaaggcacagactgaatgctttaaaatcttgtctcatccacagaaatccacaaagattatttccatagatcaaggacatagtaatgctgtttgccctttttacatagtagtaccgtatatttattagctctattgatgaaaataggagagcaactctccttgatattagagaccttggcaaacgtaaagtacttaaaaaatgaatagactgccttccgaatgtgaactcactgactaagcccagtgaaaggagagtatggcatgaaatcagagaatgatgaatggccaggattacgcgcgcgcgcttgtgtgtgtgtgtgtgtgtgtgtgtgtatgtgaaaataaacaatatgattagtgtttattctttttaacaatccacaaattgcctgcttttctctacttttttttttgagatcaagcctcactctgttacccaggctggagtacagtgggtgtgatctcagtgtactgcaacctccgcctcacaggttcaaatgattctcctgcctcagccttgccagtagctgggattacaggtgcccaccaccacgcctggctaatatttatatttttagcggggggttgggggcggggggattcaccatgttggccaggctggtctcgaactcctgacttcaggtgatccgcccacctcagcctcccaaagtgctgggattacaggcatgagccaccttgtctggcctctactttctccagttagaaagtggaagaaactgagcttcaaatgtcttgcttacagctattttggggctctgagttgagatttttgttgtaccatttgtgaagccatccaggtgctgggtctaatcattcctgggcaactgagatacagaaggagccccagctcagatggtgcacgggcacatcataccctgggcattatttttgccctttttctggaagtacgattggaaatgggcagcagatggaccacttcgcattttacccgttcaagcaaggggtatttttcttctaggaagtgggatttccaagcaaaactgccgctttggtagtcacttgccatacttcagtgtccatggaaaaacaactgcgtataggaagagggaagggggacatagcgtgccaactctaactctgatgtctgcaccactcatccataatccatgtcccagtggggaaggtgatattccctggcatctacagacccagcaggcacacggtgggtgagtgggcctggtcacctgcaaccgcagtagaaactctatcccaaggcaaaaggaaattaagaaatccatttgtgaataatattcacaactacaatactgttttgttggatctttcttagtttcttcagttcaaggttgatttgtggcccatgagtctctgatccagacatttgaaaatctctagactcagtgaaagtcatgttaattataaaatcagtaagtacactatacaagagcagctttgagcttggtaggaagacggccttcccaggaaccagagaggagagagccagctttgaccctgcgaggcacatgggagaaaagagttcagttggtttatattctatgaatttactttccccattggtattccgaagtgttcactgaaacacagctgctcctggcactctaatagacatttcccaggacctcatggcagccttatccacagtctccagcctgcagtcacatgtatttttcaggggttcactgttagccctttgagcaaatatttatagagttgtttttaaaaaattactgatgctgtaattaaaaagaacacttaatccaaattacttaatagacgaataaatgagtgaataatcaaaacatttaataccactggtatatataagaaatgaattaatttcaaagtgtggaaaaattatgtgggcttcttatcagtggtattaatctatttttgatacataaaccaccctaagaggttttcctatctatcccaagtgtcattttgcagtattagtttctctaggatgtgttttcattagcctcttagatataaatggctataccactaaaatgtaggaaaaatcccaaatgaaagccctttccctattcaccctgttaagcttcctcttgatggaagctctcttcacccttgaaagctgctaggaggtaatggagggcactgtggccacccagccctggtgcactgagtacctttccttaataaatcaccgttggagtcctatggcaacaacctaacttgataacacatatatctagatgtcttgcttcattgatatgacagtgatttctcttttcatactcaccttgggaatctaagatgttagaagctaataaatcccccacacataaaacatataatgatacattcagagaaagattctctaaactgatttcagcagttcttacatataatagaaacacagacttgcctaccatgattttgttacttttgttgtcatagcctcattcattagtttgacaaatacttgttgcccatctcgagtgttccaggcaccgtgacaaacactggttatgaacagcaaaggagatggaagtagtccctcctctcaaggagtctgtcctctactggggagatacagggaggtatccagcagtacagcctgtctgtctggaaggagcccaccccacatgcagttgaaaaacacagcatggcagatttttcaattttaaaaaaaaatcacgtgctgattttataacagattttaaatatgacctaccagtagattatagttcatcatttttgaaaggcactgttgttaacgatgtagcaccttcccgtcactggtatctcagtagccaccagtcagagcagctcctagcagactccagaatcatgttaatatcttccatccgatcacctctctgaagactgtttgtagataagtgtgtcttaagtgaactttattcgaatgaactcctaccctgtagatgacagtttttgcatgaaccgtaatcagacatagatcttcttagggaacatataatggggaaaataggacttggccagtcatggcagatgttcattgatgtgtgtcatatgaatagatggatgaatagcacaaggtaaagagtggtgtgttttataaggcaggcacatgcagatgttatgaggacttggcaaggctagtagtaactccttaaagaatcatggaagacctcaaaagccaggaggtggtgtgtgagctgggctttaaagtaagcctatggttgtgccatctggaaatttaatttcacaacatcctggaatgtgtttccagtgaatgagtcaatgaaatgacagaagtcagtggacaaagattactgggaattttcctgcaagatgcagcactcagacctgggtttgaacccaaactctctcctacttttaccccaggacttttcccttataagacaatgcatgtgaaacgtatggttataaagctaccccaaagtagaatcttttattattcttcagtaaaacccttcatgggatgagagtttacgaataaattcagagttcatctggaggtgcccggtggatctcttgatgtcctagcttcccaggtacattgccagtttacaggaaaatatgcctttttgaaactgattgaaaacaaattagctgggttttcttggacgatgaatctgtagtttttcaaagatcagaaaattcctgttctccaagaagacaggtgcagaagtgatcatctgaggctgctctccaaggtcctcagtgtatttgcaatttcctcagagtctgtcagccatcacagcatagcctctttcttttttctggatttcttttttattccatgataggtggaataaggcaatctgggcccagtaatgcttgttttttaactcagtgtcatcactatctctcagccagtgttgtgtcccacccaccaatggcccagtgaaaagtgatccagaatcccttctgaatcactgaattatttgcacacaaactcatctatctgatctgtccatcctccatgataaacggaaattagtttcattttctgccctccccttcctcctggaatatctgactcttcaataaatgagaagacagagttatggttcatttactgacttgattttaatatttcggagagcatttaaaacatttatagcgcagcagtcttccttttcataggaaacaaaagtcttctaaaaggcagtctcatttcccgtgtggttagttgaatacagaaaccgtgtagtcagaaggaaggggctgccctgagtcagcccgggctcccggggctggacggagcttgcatttctgagctcccagggcgcccccaagtggcgatgtcaagctccaagttgttctcagtgtgctcaacagcagcgcttttataaggttctttttgttttgttttgctttggctttgctgttgtttgttcggctgcttttatttttgcagttggctgaattcatccgagggttatacaaatcaaaaactgtaagtggagaggatctaccagttgttttgcaaagatagaggtgctatcacggaggatgctgttggtgtggcataggtgggaaagagaagcagtaagaagaaaggagaataaaagagaaatccatgaagctgtaagaagtgtttttttgtcactttttaatgctgatttattcacctggatcaaaataaggaaaaacacacgaggtctaaatcatcaaaataagttgcaagataaggcagcacgcttcatgaggctgtttctcttgctttctgttctcaacaccagttctgtgtaagatgacctgcaacatagactctgcatgtagaatctgttagtggctgacccctgccttatataaacaaggctggtaaatatggagcgaggctcacattcaaacaacaattctatgggctggattaagactcaaagtccctaaacactcatcaaatcatgttgcctctcccatatgcaattccagaaggataatttattttgttaactaataaaagcaatatcatgtgtgctgaaagtattttttcccacatattctgtgtacagaattctatatatgttcctaggggctggaacatttttcctttaactgtgattcttattctgattactagtgttctgaatgcacacttagcctgcgtgctacatggcctgtgcagctctttcctcctgccccgggaagaggatttcaagcctgtcatcttcaactcatagcagccttggtggagtgggttccaaactggctcttatgatgccagctcaaagtcagcctcttgggagtctctttagggcaacagggttttgcctttcaacacaacttaagtataaagtgcagataaacataagagtgttattttaaaataaatttgctaaagcattatttctcttttcccctctccctcctcctctgtccttcctctaccctcctctttcagactcatactcctcctctgtggctttacaaatcctggatagaaaacatctcacaaaacatgttctcttctcttcacatatttaagaggccttcgagcattgacacacatttgcctccagattttctagttgaagaaatgtgcaaaaatcaataaaaagcccaaatacagtggtatttttccccagagttatggacaataacaaataatcaggtgggaaggcttgatgattttctttttagattgtgagctacaggcggccatatgtgttttaaaggttaggtacataaaagaagttttgaggtttcccctctgtaacaactgattggccctctcgggaactctgtgcttaaataaagctgataggattggcctctcttagcatgcttatgccatagatgagcgtctgatgcttagcgacctatcctggtgcaagagccaggcagtggaagaaccaggtgtgcagtgtgtccaacaggaatgcttttggctgtgaaacaattcctggctgaaagggcctaagcccgggggattttatctgggtgggaagaggattctggttttagttcagtacctgcatgctatcagggctcaaggtgtgcatccttgcaaacactggccccttcttctcatgtttgttttttttgttgtttgtttgtttgagacagagtctgtctctgtggccaggctggagtgcagtgagtggtgaaatcctggctcactgcaacctctgactccctggttcaagtgattctcctgcctcagcctcgcgagtagctaggattacagtcatacgccaccaggtccagctaatttttgtatttttagtagagccggggtttcaccatgttggccaggatggtctcgatttcccgacctcgtgatccgcccacctcggcctcccaaagtgctgagattacaggcgtgagccacggcgcctggcctcttctcatggtttcaaaaaggctacagcagctttgagcatcaaatcctcacacaactatgttcaaagacagaaaacaggaggaagtgatgttggcaggccaggggaggggtccctcctctgaccactctctcttaccagagagaaaaataatctttgccacagcctcccagaaaactttttatttctgcttcatcaagcggacacccttaacttgtggatattctatattggcaggtaaataagtgagaagggatatgggtgcagcacgggggcaaccaatgaaaggttggccatacaagcaggtgttccaataagacagaagaatacatgaaccatgctcacaggaaaatttatatagtttcctcttggaaaacaacaacaaaaaccttctggtcttatccaaagcattaattggatgaaaaatgtcaagcttttctcagtgttcggtgcagtacaaacgtaggattatttctaagtggaggagcaatagaagatagcactgtagaactcttccgtcatgccaagagaagttagatatgaccaatacgatgaagggaaatgataaggtgacattatccctgagctaaaagtcaccgaatctgtgacaaggtatgggctagtcaacttgtggagctctccagcccccttctcaatgaagattttaaggcaaactagaattgcattacatttagtgattatttttcctcaaagaccaacgacttcaatgggagatagaagagtctgtggatcacttgcttttattctcttcctatagctgtgaaaattgattcaagaaattgccaacattccactttaatcagggtagaaaccaagagttgggtgtagtttatccattgagatgctctatgcattggcaatgccatcatttaaaaacatcatggagactgtttttagtcatatggacaaatccaagcaggctgccttcccaggaaatcaggagcaacctatgaagttctaggcttgaagttttttgattggtggacttaataaaatgtagatataatcagtagattaaaagtgagtactggctgggcacggtggctcacgtctgtaatcccagcactttgggaggccaaggtgggcgaatcatctgaggtcaggggtttgagaccaacctgaccaacatcgtgaaaccccgtctctaccccagctaaaaatacaaaattagccagctctggtggcgcatgcctgtaattctagctacttgggagtctgaggcaggagaatcacttgaaccgggcaggtggagtttgcagtgagctgagatcatgccattgcactccagcctgggtaaaaagaatgaaactccatctcaaaaaaaaaaaaaaaaaaaaaaaaaaaaaaaaaaaaaaaaaaaaggacctattccaagattttcattaaatgctcagataagtataccacccgaggatcagtattataaccaggtatcttattggaagtcttgtgttttatcttggaatactcatgagttcggtattccatctcctggtatatttggattggataattttatgttatttgataaaattgcctactcaaggaagatagttatcctagggatttgaatatctcaattgggaaactcagcattcattgagaccacaatcaaccatttacatctcattttgagttggacttgaagttgtggatgatatcagagccctgagagagagaaatttaaaaaggaatcctgaaaggcagatgtaaatatcgccttacactgcttcttcttttaccccaagatggctaagaaagccttcaaagtcctttgaaagcattaatttatccaacttttcccacaaagactgaaatgggtctgcatcaatgatgtaatttgggtattgctgggttatacaggagcacaatggtgatgattatgggtgcgctgcagaggactgagttaatggaatcccatcagggactcagagcacaaattcggggcacaaacaggacccacctcatcccgctgcagctgagagtcactgttgttgctgctgtgagtgagggaaaaggctgatcaaattgcaggctcatgtgactggtggatttatttagccaatgggcaatttcggtgtacctctcaagcaaaatataagtaattgttgagagaattacttttttgattaccaaattactatgatttgaaatgcaattagtagtatagacaaacctatttttcccctttatgagaaggaaattgttcggaaatgggtatagtggtgctgataaagttacagtccacagtgaattaaattacccacaagaagcagatacatggtttcatttcagttttattgctcctaatgcaatttgttttcattaatgagaacccacatgtatgcatgaatcagggttttgcactgatacctcctgtgtggggtatttctttttccaggttaggtttcattctccatatttaagatctattgtgtgtatattgatatttgcctataaatattaaagatgcacctgtggttcagagaatatgttaaaattcaagaaaagctaccgatctacctaaagtagcatcaactcgttttttaaatttgtagatatttccatttgtacatggaaatttagagggaatcttaagtgacggtgaaaaataaaatggattttataatgaaccctttaacatgcttgaaaggagtggattcaggagaattaagttcatgaaagtcaggtttgaactttaaatgtttattaactttattgatttttaattaaggacaggatttttttattgcattgaaaaagcaatgagtccaaactagaggcacggaagattttttttatgaaatcagtgtttgaaagtaaggcttttttttctttgcagttctgcagagttcttctgccaaattgcatatgttctggcaagatgggaaaaggctctctgctaaggtacaaaatcagagtatctcagataagccacaacagttgtggtatgatagtttgaccatatctttgcctttgctttgacaattcccttttgatttctaccttcttcctgacatgaaacttaaacatcagttcaagggcgaaacagcatctgaaaatgtcctgcaaagactaaatggactgcattcttttttgattctgaataaagtcttagaaaagataaaaaaaaaaaaaacactccctccctcatttaaatggtttcttttttttattcttgaaaaatccttacccttaggagaatccttgtccaatcctttaaatgtataagctgttatctgagacctgagcaaacatttgagaaatcttccaggtcaccttggtgccgtgaagaaaattgctctagtacattgctctagtgcagtggttctcagacttgtgcatgcatcagaatcatctggagagcttgttaaatgcagcttgcccggccccagccctgagtttcagctggtctgagacagggcccacgaatctgcatttccaacaagtccctgaatgatgctttcgctgttggtccagaaacaactctttgaaagccactgtatgagtagattaaaaatgctacttggtgctgctataataaataaatcacagctttattgtgaacacatttgcaagctagtggtttctaacagtccttttgtagtaagactagcagtgctccaaatgtaccaaaaggagcaagaaattgagaaaacggcatctattcacaaaagtaaagcattatcagtcggataatttgtagtatcagtcttgcttcactttgaggagtactgatgatcatctgcatgaaagcaagttcactgtagttcatgatttcatccttagaacgtagcgcaatgaatggcacatagtcagtgctcaggtgttaactgaataagtgaaatgcctacaagaagcatggacttgaccatgccattttttcatgcattgatttggctttaatgacacaagcatgctgtttaaccaattatcctcagtgacttacccaacaagtatttatttcaagacccacatttctgctggttaactgtgattcagctggtctacactgggctcggctaagagactctgctttgtgctccccaattatctggcttagccccaggctgtgggttgtattgaggtcttctccaagtgtgtttgttctggggccaggctaaagcatcggctgttaatagggacatgtttttgtatggtggatcatcagagtgcagaagccagctagggtatgcaagcagctgcaaggcctctgcctgcatcatgtccacgcacatcccattagtccaagtaagtcacatgaccagtctcaaagtcagggtggcagtaggtgtcaggggacaggttaagatgcttccctgcagggggcatggggtggagagtagtatttgctgaacaacattccagtctgttacagtttacaatatggcaataatggcttattccatttagaactcaaagatgagtgttcaggagctggatatttataggttggaaatgcaatcacatgctccgctatattatgctcttgaaagaagatgctgctactcagactgtcccactgaacatctgaaaagggggtttgtcacgtaaaggaagactctttcctcttccctccttatgtttcacagtcattgtgttgttggaagaagagatggaaagatacactggaatctgcagtacttggacctgggggccaacttgctgggcttttcttattttgttatttctggccgacaagccttctctttcgggggtgaattaagttgtgctcacactcaaccctccctaaatcttagtccagatgcacattttagaaatacactatacccccttcctttatttgtaactgcagtaatttttagtgaagtcaagttttccactctctgtaactgtttctattagcctgcaggagagtaccaatttacgtggcaggatttattgagttgacactggctctgtttgttttgctgtcaggaaaagacgttgcatttgactgaccctatctttatccattttggttttgctgttgctttgaagtcaaagcctgagaatgcctctgggctgatgccaatgtccccagaagacagtgtaagcccttgttccctgtggctcacagtcagttctaaggctgaccataccgcaagcaggacttggtccttcacaaggcatgccagtggtcagcagagagaacagacacaagctttctcttctttctgaatgcaaccatcacctctcctggttacaaaattaaagcactgaagtgcagagactcattcctatcactttaacattgaagggaatcatatttaacttaattcacctgaccctaagaagtgtgtggtttgaaaagggcaaggcgctctaggggcactttggagcagaagtcatatctcgtttaatctaatacagtttgatctatgaactaagacgttttggagaacaacatggttatggtcaaatgatcaccagggacaaacagaaagagaagagagtcttctataccccatgctccaaaaacctaagagccttgggaagcactgtggaaacgatcattgtgtcaccagaaaataggaaatgacaggagttcgtgcctcctccagggtgagaggtgattatttggataatttctgaggcaatgttggtagcacaaggcaagatttgataaatattcagagggcagcaaggaagttttagagaaaataatatatattctacgtatagcctacagatattgatccagagaagggacatgcatgaaggcaagacaacagaagtgaagaaaggtagttagaaagtgggaggagaagagtcgattatggttcaatgtagaaaggcaagatgaagaactaggggagaatcctagaggaaggtggtaaggttgtgagcagccctccgaggggccacagagaaaacatgggatgaggttggcaccagccatttgcgtaggatcaaaagcttgtgcagctcacctggcgataaaccttaacactcgtgttaatcaaccactgtgtttgtgtacatgacactagtgtagttagttgtacgtatgttttgaactgtgtaagatccaagcagtgacacaatggtagggctaaaatgcagagacatgtgctattgggagattgaagcttaactttactgatgttagagaaaggctatttattgggttacaacaaatgattttacataaaacataatttttaagtattaagttgaaaagcccaaattgacccaattcatactttaactctgtttttcaaaagcctgaaatagcaattattgtgtgtgtgtgtatgtgtgtgtgtcctggatatttcctgtttgaaggtgtgtaaaaggtcttactacccagcccctagtggagagttctcttgcaaaaaacaaaaacggaaacaagaaaccaaacatgctttgagagatagagagtgagaaacagattttcagagtggagaatatgccttctatttatgcatttagcattgtgttttctcaagctacccagattttttaaaatttctccccgtttatgagttcaagctgataatatgtaaaagacagtgatgcccactgttttagggaagaccttccttcagagtatgctaacttagccatttcatttcttcaaatattagtatttggaaaagaaaaaacagtcttaaatatggttctgtcctccctcagcacccagagaaaagggaagtcaactacaggatataattctctcagaaataagaaaacctcttagctaataaaaatcatgcttaggctgctaaactcaatggatgtacttttgttattcctacaatgcttagcttgcaggtagaccaaaaatttgccttcattgtcattttaaaaatgactatccaacatattttgcagcatctgcctaatcccaatgacttatatttgttttgtaaatttgttctagggaaaataaacacacacccacacctttgtaataaatagggaagcactaatcatatgaaactagatagaaaaatgggttgggggcatttggtttggagcagcatggaagaattaaactcgacattaaataatttgcaaaatattttcaaaaatattttctcacacttacccaataagtaggaataaaaatctgcttcatcgccacagtgtacttcaggcgttcaaggagaaattgagtagagggaaatattgacatgtttccttccgaaccactacacctattttgaaatgcccattgggtacttttgctcctcttcggggtatctttttccttgtttgtgtgtgtgtgtgtgtgtgtgtggataaggggaggtgaaaggtgattagagacaagaattgaattaattatacatcataaacataacatgccatagcttgccagtctttaaaattgtatcacttcacttattctaacatactaaccactttatttttttatatgtgggaccacagtgtcctcacaccctcgactgcaatgtgtgtatccgtgcttaacacaaatttggatgtgtgggtgcataaacgtgcatgcacatacacacgaggtatagaacatttatttatttatttatttatttagagatggagtcgtgctctgtcgccaggctagaatgcagtggcgcgatctcggctcattgcaacctccgcctcccgggttcaagcaattctcctgtctcagcctcctgagtagctgggactacaggcgccaccatcacacctggctaatttttgtatttttagtggagatggggtttcaccatgttggccaggatggtctcaatctcctcacctcgtgatccacccgcttctgcctcccaaagtgctgggattacaggcgtgagccaccgcgcccggccagaacattctttaaaatgtccctagaagcaccgcgttcagtgtgcaaggtgcaagagtatagccaagcgcttttcaatttgggtaaagggcgctccatctggatcatccttgaggaacatcctcgtgttcatccatgctgtttccagtcctccccagcattccggctcctttcacacctgcatctttcagacgctcgctctttcctgccctccgtttcttctgcttaattgtgagatttgcttcccagcacaaatttttacttcaactctttcccctgttgcttatgagttttatggtgatttcattttataattttaagcagaaatcgcttatcatattttcttagataatttaattgagattttaaactttagttagattacagttacctacaatgccttgagaatatagtttttaaaagtggcacatatgctttatcccaatagtattctatctatgattaatatgcacacatctatcattgtattttgtataaactatattagtatgacatttagtttgtgtaaaaatatgcatgcatatttcatagatagcgtatgtatattacataagtgggaccctaactgcatctatatttagtgaaatgtcaggatcgcgatgctgcggtgaatagcatgagctttctttcatgtccatgttaggagaggcagcttcctcccatcaaaagcacagctggggcagaggagggggttgagagcaaggttttctatctatctaattgtggtgacttttaaagtttagttttatggctctgttgcctctgtcttcaaagtcaaatggagcagctgaagctctccccaccccagacccacctgcctggcctctcccatgcagcaagtttcgcttagctgttgcaatcctggttttacttggttttgtatttgctattttttaaagtgtttttaaactcatgtttcttcatagtaaagggtaactactgtggagtaaacagaagatgagcgtggtacaaattttggttaaaccaaaaactacacactggattgaaagcttggggaagggaggcaggtggaagggactgaaggaggtctcttcccaggagacttgttcaccggcatccagtattctcccccgcagttagggaaacagagggagcatgcagtttcaggcccaggcaggcctctctctgggcttggggcaatgccagggctgggggcgagcctgcagtcagccttgtgagtggcagccgaggctgttattttgaaaccctaagtggaaacaggcatggaaacccggaaggagcagggagccttaggcagtcctgggagatgaagccaacgccctacctccatgtggaaggaggcggcggaatgggcagggtcgggtctcacaggttcccccctctggagttggggtttcccggcccacgttcactctctggatgtgataggtccttcccggccgggaagggctggaaggggcgcgcaaggaggacgtggggacgagacgagagagacgcgtgcccagcaactccagaaggacggagaggagtgcagaagggagccggggaggacgcgggagggccgggaggggaagagaagccaggccgggcctggagcggaggagcggagcccgctggtgcgggtgtccacacaggggcgctggagcgcgccttcctgcggctgggcaggaggcaagcccgagagcgcgcggcgagtggagccatgtcgccctccctcgctctcggcgggcacagtgaggcgcaggctttggaaaagttgcgggcagccggagagccgagcctccgcctgcgttcatgataatgagaatggagtcgcggtcacagccgggctctctgcggggcgcatcgcccgcgaggggcgcctgggcctctgggcgtcctctgccgccccgcgacctttcctgccctcctccggagagaggcgaagggaaggggcggtttcggagggagctgggctgtggagggagggcggcctcttcaccagcgtcgtccgaccaccccgcgccctcctggtggctctcccacgccccattcgcaccccaggtcctcggggtgtctctggtgttgcttcaagttaggcaagaggagctgggggcgcggggagcccggcgccgcagcgcgtgcgtggctggggcgccccggggccggctgcaccttcagtcgccccctggccggcctgcctgcctcgacctccgcatccccttgcaccgtccgctcgcgtgctgcggggcactcgcagcactaccttcggtggggccgcagcaccctgagctcccgggactcccccaccgcccccgcacccacgacccgcgtggtcccagcccctccaccctcttcacgcaccctcgcacccttttgtgcgaccccgtgccctctccgggctgccaacccctgccacccaggtgccagtcccgggcgcggggaggaggccggtggggaagggggcggaggggccggggtggaggaggagctgcgcgaggggcctgggggcggggagcgaggagagcgctcggaatgtgtgccggtctctaggtggtgccaaattctggggcctaggcatttccctcgctttatgtttttggttttttttcttccttcaatctctttgattaggccgtacgtggctgtggcaaggagttggggaaaaaaattataaaaacaggaaagagagaaagcacagccagagccccggcttcgcgagccgccggggagggggcggaggaggctgagccaggcagagtcgccagcggagactcgcgagtggcgcgcgggaggagcggccgccggcgctgggcttgccttgctgctgctgctgctgctgcctccccaccgcctttttttttttttaatctggagcggggtggggagtgggaaccggagagaaagcaaaatattaaaaagccccaaagacagccagcaggagcgcggtgcccgatggcttcgctgtaccagaggttcactggcaagatcaacacctcgaggtccttccccgcgcccccggaggcgagtcacctcctgggcggccaggggcccgaggaggacggcggcgcaggagccaagcccctcggcccgcgggcgcaggcggcggcgccccgggagcgcggcggcggcggcggcggcgcgggtggccggccccggttccagtaccaggcgcggagcgatggtgacgaggaggacgtaagagcttctcgggggcggggggcggcggcgggttctccgggctgagcgcgcagcgagacgcgtcggcaggggaaattttttttggggggggaatcaggcgccctccccccgcccacgactctccgggcgcccccagacaggctccgtggcgccagatcgcggtcaccgcgtcccggagggagcgggtctgtgtctgcagccgcggcggccgggagttggtggctggagagagcggggtttgggtactgcgcctgctgggatctggaattcgccttacgttccctgggtgcgcggatgtctgtttttaacagcatgctgctatggttcctaaggagagaattcgatcggcctgtgcttacgagttggtttattttttatttatttcgtgctccgggaacacagcctcaggcaccttctctccctcccacctgtgtctggaatctctccatcgtgcccctcctctcctactcactctgtcccttgactcaaatgcctctccttcgttcctcttcttacttctcctagacactttttccccccagcggtggtgatggtgattatcctttccggaaaaaaaaaataccaaaatactggcatctgagccccaaccctctgtcccagggcccagctcttttgctgagagccctcaggccgtgtctgtctcccctcccagccctggactagcacctctgccttagaccgtgttcagtgaaaacttctccgagagcacatttcctactcttcatgggggctggaagcctgggtttcaaaggttggatttgcacatcgccctagtaaccaatgactcatgcaggacaggagccggaccttagatggatgcgtttaaccacctcctgtggatccctttcaaggatgcagagggctgctaggacttagaagggaggaaactgtgctttttctttgaggccttcttttcccagggaaaagagaaaaatccccgacaggctctcagagaaacaggtctggcttggctggtacagctcttataacagctaggctgtgttggtttgtagaaattactatgtatgcctttgaggagtttcacaactgctcaacctgggaaccgcaggggtcccaccggcctctcacttagtctaccctgacatacccagggcagtacattgccgggcactgagtaggtggttttggtcattacctctctgcagcctccagccacgctggttccctgtttcgtatttctttagtgcaagagttgtgtttgggtcgagggaggggtgagacattgagtgatttcccagggacaattcctaattgccagatactatgaaatcagtgaggttttgctgttgttattggtagtttttgttttatgaatgaaggatgtggaaactttaatggagatcacaaaactttgtgggagatgtggtttgcacacacacaggtacacaccccctacagccctgcgtcagattttgcatgaggttttgtgattttctcctgcatcgtttccagactcccctggttaaatagtcattcaaaggcatgtccctcactttggtgggccaagccctgagggaaatagacagatccttcagtcatctggttcaagtctttggcaaatggtttaattgggggagggtgaagagttctggaggattaaactaccgagaatcttggggaagacagttaagctgcaatgcaaacaggaaaaatgtactttttaccttaaatctgacttaaaattgttgaattgtggatgtttggaatgagaacaatgtgcagtttttttctcaacaggctctaggtgtcgctaggagaaaggaaaggcaagagctctgaattttatttcagatgatctccatctttttttaaaaaaatcttaacttggagtatacatgtccttctttttattgtgacatgtgtctagaaatgattctcagataaacacaggtgtcctgagaaacaaatcagggatataacatgtacatttgttaatggggttctaaacagcatctctaacttagatgtaagtcctgacatgctttttttttttttttctggaaaatacacaatgtgtgtgggtgggcgtgtattgtgtgtttatatagtgtactcccgatatatatatgcacacatatatacttgcccattatctgcacatatatatctggcacacatctgcaaaatgcattgcacatatgtcctttaaattgtataattaaactcatgacacaggctgaatgttgcatcctttaaaaacaacaacaaacttttatgcactcttcttagaaaagttcctcagaataggaaaagttatgcccccaaatttactaaaagatagatgaacatatcaaaccacttttcctccaggaacaaaagcttcaatttgcttaaagtgtattgaaaaacaaaaacaaaaaaagagattaggtagaaaaactgctttttaggtacagatacttgccaaggcaaggctgaagaatctagagtaatcattttgctacccaaatttaaagctgaggatatgcaatgaattaggaacacattgcattttattacgtgtcttgcaactgctgacaacctcaagacaaaccgaggctttccttttccacatctgcaagcagctgggagcgccgctacttcggtgggagctgtctgaggtgctgaaaccttctcttggcttagcgcaggagaaatctccatcactcttgccttttcagtcctgatcccaaggctggtggctttatcgctgttctctggcttgtcagggaagactgttccaaggtacagaaacagcttcgctgccttggtcactaagatgatggcaagcagcatacctttataatccttaggactttgtacctgttgtccttctgtctggaaattgagaaatatagttcttggcttctgtgcatgtgtgtacacctacatgcctgagcatgactgagaatgggcaattacccagccacaacccaaataaaatttatggtagtctaacaaggctaacacagagaaataaaatgcggagatagaatggctagaattaataatgcatggtctaaatgcacaaactacacaggcaacaaagggacttcccaactgtgtggctccacaggaaagcctgttttgggtgggtcagtactaacatgcaaagtctgacttcaaaatagaaataaaaccagagggtcttctctatccacttccttgtaaatcttagatttatttaaatataaagtcaattacttgggcaactcctctgaggaatcaatagcccttctgatttaaaattcattgtgtaggtttaaaaataagttgactcttaaaggaattgttgctggaagtgacttttagtggaatgtattaactttcatttggattaactgtggctaattttaaaatactgaactttgtcatccgcctgcttgaacatttctttttagttttttaaagggctttggaggccttctgtaccattagagcagtagtttttttaaggttatacagtgtgttcctgtatccttcattttcagtgacacgtggcttcttagcaatacaaatgtgatgacaacaggattttaaagcagcaaattggttaaaactgggatagatgggcaaatcaccacccatgatgtccaccagccttggaagggccaatttcatcatccgctatgtcttcggcaaccaacccatttttttcctccaccttggtttttcattggtataatgtcaacattctgttaatgtgtccttgggatctatcaactttacgatttcttaactagcttccctctacaaatatgtttttatactctattacttttcttctgtttcaactgtaatttaaaattttttaagtttcacatgattttcctgataaatgagaaaaagtctaaatctttcaactgtctatttgatcccattactctcatcaccaataggaccagtgcttggtgtactcacctacagaatagctatggatattgcaggagcatggagagttgcaatgttgccctctcttgatcccagtggcccctacaaagtgggagccatgaggccaggtactgagaagtgcccagtgaatacatgctgctgctgttactaataatattactgtttctaaaggatggccaccctgtttgagggccttggcagcaactgcccagctagtacaagaagcaaaaaagctgactcttgggcaaaacctgaacataaaggcctcccatttcgtggtggttgagagccagcccctcttccccctctggctcttgtgacccccatcacagggtggggagacaccccccgcgaggcggggactgagagccagcccctcttcccccactggcttaggacgcccatcggggatcctaagatccttaggacccacctggaggactgtgggtatgaggtgttcaagaagaaagctcaaatcttccgacggcaggtaccttgcgtgggatttacaatacgacaggggtccgaacgcagctcaggaacagaaagaaagcaggttatttgcaatctaccggagcttaagggcagaaggcaggtgagagaattcttaggagctgtggggttttgtaggctgtggatcccaaacgttgcagtattagccaagcctttgtatgaggtcacaaagggggcggggacccggaacctttgaaatggggatcccgacaacagcaagtctttcattagttataagaaaatcttctggcagccccagccctggggctacccgatctgacaaagccttttccattgtatgcgtcagagagagaaaagatggcagctggacttttaacccaaactgtggggccctggctgaggccggtagcctacgtctctaaacaactagacagggttgctaaagaatggcccccctatttgagggccttggcagcaactgccctgctagtacaagaagcaaataagctgattcttgggcaaaacctgaacataaaggccccccattttgtgatggctgagatccatcccctcttcccccctgactcttgggactcccattgcgggtggagggaggcatcccccatgaggcggggactcagagccaacccctcttcccccccctggctcttgggaccaccatcgcagggggggaggcaatccccgcgaggcggggactgcgaacctccccctttcctcccctggctctttgcacccccatcgcagggggggaggcacccctcgtgatgcggggactgagagcgagcccctcttcccccctttgctcttaggatccccatcgctgggggcggaggcaccccccgcgaggcagggactgagagccagtccctcttccccccctggctctgaggacccccatcgcaggagggggaggcaaccccgcgagggtggggactgagagctatcctctcttccgcacctggctgttggtacccccatcgtagggggggggaggcaccctccgcgaggcagggactgagagccaacccctggttcccccactggctcttaggacccccatcgcagaggggggacgcaccccccgcgaggcggggactgagagccagaccctcttccccccccagcttaggacccacatcgttgatcctaagatccttaggacccacctggaggactgcgggtggtaggtgtccaagtagaaagttcaaatcttccgacggcaggtaccttacgtgggattactgagagccagtccctcttcccccccggctctgaggaaccccatcacaggagggggaggcaccccccacgacagtggggactgagagctatcccctcttccgcccctggctgttagtacccccatcgcaggtggggaggcaccccctacgagagtggggactgagagctatcccctcttccgcccctggctgttagtacccccatcgcagggtgggggaggcacccccccgcgaggcagggactgagagccagcctctgttcccccactggctcttaggacccccatcgcagaggggggagggaccccccacgaggcggggactgagagccagtccctcttccccctctggctcttaggaaccccatcgcaggagggtgtggcaccccccacgagggtggggactgagagctatcccctcttccgcccctggctgttaatacccccatcgcagggtgggggaggcaccccccgcgaggtagggactgagagcctgcccctgttcccccactggctcttaggacacccatcgcagaggggggaggcaccccccttgaggcggggactgagagccagaccctcttccccccctggcttagggcccccatcgttgatcctaagatccttaggacccacctggaggactgtgggtattaggtgtccaagtagaaagatcaaatcttccgacggcaggtaccttacatgggatttacgatccgacgggtccgaacgcagctcgggaacagaaagaaagcaggttatttgcaatctaccggagcttaagggcagaaggcaggtgagagaattcttaggagctgtggggttttgtagactgtggatcccaaactgcagtatgagcaaagcctttgtatgaggtcacaaagggggcggggacccggaacttttgaaatggggatcccaacaacagcaagtttttcatgagttacaagaaaatcttctgacagccccagccctggggctacccgatctgacaaagccttttccattgtatgcgtcagagagagaaaagatggcagctggacttttaacccaaactgtggggccctggctgaggcccgtagcctacgtctctaaacaactagacagggttgctaaaggatggcccccctatttgacggccttggcagcaactgccctgctagtacaagaagcaaataagctcattcttgggcaaaacctgaacataaagggcccccattttgtgatggctgagatccatcccctcttcccccctggctgttgggacccgcatcgcgggaggggaggcaccccccgcgaggcggggactcagagccaacccctcttccccccctggctcttgggaccaccatcgcagggggggaggcaatcctcccgaggcgggactgcaaacctccacctttcctcccctggctctttgcacccccatcgcagggggggaggcacccctcacgacacggggactgagagcgagcccctcttcccccctttgctcttaggatccccatcgctgggggcggaggcaccccccgcgaggcagggactgagaggcaatccctcttccccccctggctcttaggacccccatcgcaggagggggaggcaccccccgcgaggcagggactgagagccagcccctggttcccccactggctcttaggacccccatcgcagaggggggaggcaccccccgcgaggcggggactgcgagccagaccctcttccccctctggcttaggacctccatcgttgatcctaagatccttaggacccacctggaggactgcgggtgttaggtgtccaagtagaaagttcaaatcttccgacggcaggtaccttacgtgggattactgagagccagtccctcttcccccccctggctctgaggacccccatcgcaggagggggaggcaccccccacgagagtggcgactgagagctatcccctcttccgcccctggctgttagtacccccatcgcagggggggaggcaccccccgcgaggcagggactgagagccagtccctcttccccccctggctcttaggacgcccatcacaggagggggacgcaccccccatgaggcagggactgagagccagcccctgttcccccactggctcttaggacccacatcacagagtggggaggcaccccccacgaggcggggactgagagccagaccctcttcccccactggcataggacccccatcgttgatgttaagatccttaggacccacctggaggactgtgggtattaggtgtccaagtagagagttcaaatcttctgacggcaggtaccttatgtgggatttacgatccgacgggtccgaacgcagctcgggaacagaaagaaagcaggttatttgcaatctaccggaaattaagggcagaaggcaggtgagagaattcttaggagctgtggggttttgtagactgtggatcccaaactgcagtattagccaagcctttgtatgaggtcacaaagggggcggggacccggaacttttgaaatggggatcccaacaacagcaagtttttcatgagttacaagaaaatcttctggcagccccagccctggggctacccgatctgacaaagccttttccattgtatgcgtcagagagagaaaagatggcagctggacttttaacccaaactgtggggccctggctgaggccggtagcctacatctctaaacaactagacagggttgctaaaggatggcccccctattagagggccttggcagcaactgccctgctagtacaagaagcaaataagctgattcttgggcaaaacctgaacataaaggccccccattttgtgatggctgagatccatcccctcttcccccctggctcttgggactcccatcacaggggggggaggcacccgctgcgaggcggggactcagagccaacccctcttccccccctggctcttgggaccaccatcgcagggggggaggcaatccccgcgaggcggggactgcgaacctccccctttcctcccctggctctttgcacccccatcgcagggagggaggcacccctcgcgacgcggggactgagagcgagcccctcttcccccctttgctcttaggatccccatcgctgggggcggaggcaccccccgcgaggcagggactgagaggcaatccctcttccccccctggctctgaggacccccatcgcaggagggggaggcaaccctgcgagggtggggactgagagctatcccctcttccgcccctggctgttggtacccccatcgcagggggggggaggcaccccccgcgaggcagggactgacagccagcccctggttcccccactggctcttaggacccccatcgcagaggggggacgcaccccccgcgaggcggggactgagagccagaccctcatcccccaccggcttaggacccacatcgttgatcctaagatccttaggacccacctggaggactgcgggtgttaggtgtccaagtagaaagttcaaatcttctgacggcaggtaccttacgtgggattactgagagccagtccctcttcccccccggctctgaggacccccatcgcaggagggggaggcaccccccgcgagggtggggactgagagctatcccctcttccgcccctggcttttggtacccccatcgcaggggggggaggcaccctccgctaggcagggactgagagccaacccctggttcccccactggctcttaggacccccatcgcaggagggggaggcaccccccgcgagggtggggactgagagctatcccctcttccgcccctggcttttggtacccccatcgcaggggggggaggcaccctccgctaggcagggactgagagccaacccctggttcccccactggctcttaggacccccatcgcaggagggggaggcaccccccgcgagggtggggactgagagctatcctctcttccgcacctggctgttggtacccccatcgtagggggggggaggcaccctccgcgaggcagggactgagagccaacccctggttcccccactggctcttaggacccccatcgcagaggggggaggcaccccccgcgaggcggggactgcgagccagaccctcttcctcccccagcttaggacccccatcgttgatcctaagatccttaggacccacctggaggactgtgggtgttagttgtccaggtagaaatttcaaatcttccgacggcaggtaccttacgtggaattactgagagccagtccctcttccccccctggctctgaggaaccccatcacaggagggggaggcaccccccacgagagtggggactgagagctatcccctcttccgcccctggctgttagtacccccatcgcagggggggaggcaccccccacgagagtggggactgagagctatccccttttccgcccctggctgttagtacccccatcgcagggttggggaggcacccccccgcgaggcagggactgagagccagcccctattcccccactggctcttaggacccccatcgcagaggggggagggaccccccatgaggcggggactgagagccagtccctcttctccctctggctcttaggaaccccattgcaggagggtgtggcaccccccacgagggtggggactgagagctatcccctcttccgcccctggctgttggtacccccatcgcaagggggggaggcacctcccgcgaggcagggactgagagccattccctcttccccccctggctcttaagacccccatcgcaggagggggaggcaccccccgcgagggtggggactgagagctatcccctcttccgcctctggctgatagtacccccatcgcagtgagggaggcaccccccacgaggcagggactgagagccactccctcttccccctctggcgcttaggacccccatcccagcggggggaggcacctcccgtgaggtggggactgagagccagcccctcttcccccccggcttaggacccccgtcgtggatcctcagatccttaggacccacctggaggactgtggatattaggtgtcctagaagaaagttcaaatcttccgacggcaagtgcatgatagtctgcatgaaaccctaataaaaaagacagtgaaggagaatcatgtcaggagctgatactcctgagtctcgggaagcctccagggacagagcacagctagagcatccaagaatgagaagagccctagagcaaacgcaaagcccaggaagagataattggtttgagaagaaaagggtccaggagttattgcaacccagctagcaagcagagtcctgggctgatcagagtggggaaaagccactgagttgttcaatggtaggacaaacagagccctgctgcagggaggggacactcatctaccctgtacccccatacacctctgtcccgctccccgttcaggctgacaatgtgctcaccacacagcagcacctcctggtcttgattgttggggccctcgcaatcattgcactggcccgtcctgccatctgaccagagctcttccctgctacactcttctgtgagtctccagcaggaccttttgcacatcagcaagctgggcagcgtcaagtgcctggaatccaccccatgccttcccacctctggacatttgctcatggttcaattcatggccattgaacttgtcttggtcagttttctttcagctctcagtgatagacacattccacaatgacctacagagaaaaaaaaggctcaaattgtatagcaaaccactacctctactaaagtaacctattgttctttagaactgaagaccagaggctgtgggacttcagtcttatctgggatgtggtgctgacatgatgttcccaaaactctttctatctgtgtccctaactctcagatttacttttctctgtgggtgttaatctcaagcagatagcaaaggtagtttctgctctaagctcatgaagttttacagttcctaacgagagaggaagacagaggcatgctctctcccagggtctacatgtgaaatctcattcagggtttctggttgatccagcactggtcacatggcccagccacttggagtcagttgtgttgtcagagcctgcaccgcaagcgcgttgcacagacaggaacaggactggccagggagggaatctccattaggacaaagtggttctgcagaccttgcagcgtctcctcctcaaatgccttttccttacaagagcttcctctcaaaatgcacccctcctttcaggtcccattctaatgctgtcacctccaaagcagcaacctcatctacctgtctcaactccctaaatgggtgactgttcctgcatctgaatttccatagcattatcatgacacaccatcctcaccattgtcactatcttacctgtaatcatagctgcttgtgatgagcagcagctggaaggacagacatcactgccacttaaaccagctccaacaaggcagagatgaaatagaccggaagaaggggcaaggctgtgagggccctgggagcaagcagggacacctcccatcactctttgagggccctgggagcaagcagggacacctcccatcactctttgagggccctgggagcaagcagggacacctcccatcactggctgccatacagggtgaaaacaatacagcctgagtgcccacattccattccagcattccccccagtaagaacaaaacaggaagggcccaaggaaaacacaaccagcagtgaagtggagctctgtcctctttgctgtcctcactggccgggtgcacaggccaggccctactgaatactactacctaagcagttacaccatggccttagtacccccgcccccgagagcagaaattgtaagcaaattgtccatcaaggtataatggcaaaaggcacaaattaggaccaggccaatggtataaatacacctgcctgtcacccagcccctagagctccttggagaagcctgagtcctgtgttccacggacatcagtggcatagaggccctgagttggactcaggttttcctcagggactgggttttcctcagggaatggggcaagttcctgggggccaaggatgtcttctgactggcctgcatgagggcttcaggaggtgagttgttttatcctcctaagaagccgccttggtatcccactggccttaagcagtcccagaatacccataatttttcctgttggagaccctcacattcttctaagcctcaccttcatacttctgtgactactgaaatatcagccacggctaggttcagatttgtttttttttttttttacttttttttttttaatttgggacagagtctctctctgttacccaggctggagtgcagtgatacaaactcagctcactgtaacctctgcctctcaggttcaagtgattctcctgcctcagcctcctgagtagctgggattacaggcacacaccagcatgcctggctaatttttgtattcttagtagagatggggtttcactatgttggccaggctggtgttgaactcctggcctcaggtgatctgcctgccttggcctcccaaagtgttgggattataggtgtgagtcactgtgcccagcctcagatttttttacaatgatgccacattgcaattaaatggacttgtccctactgaacagagccctctgctgttgtgccctggagccaggttaacacgcatgtgctctatgccacgaagaacacccaccaagctgaggggccctgcaggcattcacatgggaaactgccattgcgaatggagtgagtgaggcagcttaagtggtgggaggggtgcatgggaaggggctcctgagcaggaccttcaagggtgctagagtttggcagagacaagagtaggagcgaagaaagtgagagtctcatgtaaaagggcaaggtcaccttcctgaacagggaagataaatcatagtggatattgtacaataaagattttattcattcatctatgacaaacttttactcgataccaaccatggcctgatgcaaggctgacaccatgggatacagaaatgcttttgagtgtcagtctggggagagacaggcatgtgagcaaataaatgagctgggtctgtcccatgaagagtctagaatagtgcagttggttagcactctctggtgacagaaaggctgtctatctataccatccaatccaatagccacttgccccatatggctgttgagtgcttggaatgaggcctgtgagattgaggaactcaattttaaattttatttaaccttcatctattttaaatttaaatagccagccacatggggctagtggctaccatattgggcagcacagggctggaggcacatggtaagaaatttatatccaataactaataggaagacacattgattagtttttttaaacctatatattaatcgtttcacaagtactagggcttcaatacatggtactgcataaataaagcagtccttgccttcaagtcaaacacatcaccttatcttattgttatctgagaaaatgcaaaggagcccatgggagcgagaggagggacacttcattcagcttcaagggtgtcagggagagttttctgggagattcgatgattaggatgattcttgaagagttaatgggagataaccttgagaaggaggagaaagctatctcaggtggaggcaacaaccccatggttatcagagaagcagcagcatcagggagaggtcagagtattcagggaggtatgtgggcctggagactcgtgcatgtggggcaaagccattcagaatgaccctcggagatgggcagggcaccatggggcttttgcatggggctcaggcctcagatgactttttttaaggtcatggggagtcatttgaaaattggaagcagacacgtgagatttctgtttttctgcttccatttcagtattttccaaaaagcagtaatgttgctggaaagaaggagagcagtgtaagagtttttgtttgttttattggttgcagtgagatctggctctgccacccaggctgcagtgtagtggtatgatcatagctcactgcaacctcgaactcctgggctcaagcgatcttcctgcctcagcctgtcaagtgcatgccaccacacccactcaaggtttttttttgttttttttttgtttgtttgtttgtttgtttttttgataaagattgagtcttcctatgttgcccagcctggtctcaaactcctgggctcaagcagtcctcccacctcggtctcccaaagtactgggattacaggcatgagtcaccgtgcctggcaagagactcgtttgaagttgaatgaaacgaacagaatttggcaatggcttagttgggaaaggagaggttagcagggaaggggcagctgcagcatgtccttaggggtgtcaacatttgtgctgaacacaggccactgtgggaggaggcatcggcttgacacagcaatcctgtggtggaggtgtttgtattttgaggttattattctattgttgattcttggagtaataagaattgagagattacccagaagcaatgggcagtgtaataagaggagagggctggagaacaagctgggtgactcccatgtttacaggcttctggcctcagggaaggcctggaaaaaaggatgggaagaagatgctgttagaatccaggagaaagctacctctaagaaagcaaaaaaggcaggctcatagcagacaagtaacctgaattgggaaagggcccagtggccccggccttggagggcagctggtgtctgcagggagggtggctttggcaggagcacaggtgtggttgaggctgaggtgaccaaagtcggattaacacgaacccgaggcacgtagcacagggggatgagtgtgggggtttcttccgggctgctgcacaggccctcctcttcccagacagcagctgctgagtgtcaggtggggggataaaggccagaagcagagatgccgctaagcccacaaacaggtgcccacgggatcagcctcggcgcccgggcgggtcttaggtctgaaggacacttggagactagatgttaactgttggaaatttagtaaactgggccaccagaggcttaattcactgctttaaagtctgatgattggaaattaacctatgagaattgtcagattacattgaggtttgatctcccgtgcacttacacaaatgcacacagacacagacacagacacaggcatgcacacacctcttttatgagacagataaaaacccagccacaaagatgtcaatgccacacatctaagagcctgtcccataagtaatgcacagggctccagcccccgtgggaggaagataattggactgtaaaatagtgaagggcacggctgggtcaagagagagtcccctaaaaccaaattccagatgatttccatattctgaatggaaagcctgcataatcattatttttaaaacatatcgacttagaaataaaatatagaagtcaaaaaatcaattaagaggactaattcaatgaagagtgttttctggtggctatttttctttttattaaagtttttaatttttttattttttgggcacctagtatatatttatggggtacataagatgttttgatacaagcatgctctagtgactacttttcaagagttaaactgtggactccagagtctgaaaataaagtataatttttgagaatgttcaaattatagttttaaaagtctttggcccattatttatattttttattcttatttggaattaagcacagtattttgttttttcaaaaatttaaacctgactgagagctaggttgtcatggaccattggttatttatcttcttttgatgatacttcatttaataacaaatcagtgttcctgtgtctgatagagttagatgaattaatcaagtcagtgtttattcctccttcaagtggcatcttcttaaaggtagctttgcaaaatgcccaattatttggacaacttaaaaaaagaactatggggccgtgcgcagtggctcacgtccctaatcccagcactttgggaggccgaggcgggcggatcacgaggttaggagatttcaggccatcttggctaacacagtgaaaccccgtctctactaaaaatgcgaaaaattagccgggtgtgatggtgggcgcctgtagtcccagctactcgggaggctgaggcaggagaatggcgtgaacccgggaggcggagtttgcagtgagccgagattgtgccactgcactccagtctgggcaatagagcgagactccgtctcaaaacaaaacacaacagtttctcatatgcaatgatccccacaccgaggtatcaggtaattgtggactgtgccgttcactgtgtactatcaggaatttaggtaaggcagcaaaagagaagaaagtttccctagagctccataccgaggtatcaggtaattgtggactgtgtcgttcactgtgtacagagattggcagggtgtgagtggcagaaagagcttcttaggcagtcagaccacctggctctgaatcctggctcggtcacaaattaattatatggaagaaaaccttaagcctcggtttgattttctcctttaaaaagtgagacaaataaatgcatttatttctcagaagatagttgtgatgcatctattattttatgacatttttgttcatttttaaaaggtcctgacaaattttaagtgttttatgtgatcagttagatgacatgctaataggcaaaaggcttgcctctaatatacatgctgtcaaattttccatcagcttctatatttgcttctctaagatttttttttcctgaatgacataattaattaatgaggtcatgcaaaattcttaaggaaaatagctaagtcagtttccttcattaaaatccactgtaaacaaagacggccctctgtttaatgcttagtttaacagaaaatttaaattagcacagataattcttcacatcatttggttaattgaaggtatgggaaactgtatttgtagtgttcactcaaaccattcccaataagtgaattacccatgggccaaactctggaaattgccagatgaactgtattatataaagatagtatggcatgaatagctgttctttcatattgcctttaatccatcctctttgaaataatagaggcctgagatacatcagtgttattgagcaggaacgcttgaatataaaaccaatcaagacaacatatagtatgaaatagtagcttatcatgtatgtgcatgcatgctattttatttgttttttgctgataaaggtggaatgatgttatgatgaatttcaccatgaaagactgaaatagagcaaacaaaacgtctcaatcagggtttgccagggttattcctaatgagttattcatactggttgtatttttttgaccattgggatttatttatctgagggctgctggaaaaaggagaaagggaagctacgtcatttgccttctgtgtgccaggcattttctctttctttatccctggaataaccttgtgtgggaggtttcattattctcattttacaaatatggaaactagcttagatgaagagagatggagtgaccctccgaaggccttgcagtcagcaagagttcgaagcggggtgagaattcacgtgtttctgatttctaaagccgtattccttccactgccctggttcacatgttagaatgtcacatctttatccttcagacatagtagctcagtctgcatcagactaagatggggaaaaacttgattcctggaaatttccaaacatacggaaaagtggagggaattaggcgataagccagttgtacccatgacccagctgtataattatcaaggcttcggcaatctcgtttcatccatttcactaccactatgatttgaaacaaatgccagatatcatttttctccgctaaaaacattttattatgttggatcctgtttgtgcccgtattttatactaagccttcacataagttatgttctaggatgtcttcaaatgagagtaaaagaggacaccgttgtcttactgctggggaaaagagagggggctttcttctttcttcaacttccctctgtgatacaagggaaaaatgcagctaaattagtctaaaatctcgatcccttgaaaacagaaaaatcaacagttttaagcaaacaaatacaatccccctagtagctaatcattttcatccacgtgcctggtacacatgctaatgttggagggaaaaaaacagggtgatgtgctttttgagtgtggacaccagagggcagagtgtactgattagagtttcctggcattgcaaaagtgcagtgcggcttggggaggaaaagcagtaggctatgaaacattattccttatgtcaatagaaggaaattattacataagggaaaactggcaagatggaagagcttatatccgcttgcagttctgttcattccccctaaactccatatattatttcaggattttcatgagaaaggctcttctttgaagaatcaattgcttatccatggtgttagtttatatgtttgtatcatgataaacatcctatccagaggtgtgaccttccagaccttgctaacagcatgctgctgctttgcaaagctgcctgcgctttgctgctcacctaaaggaggacttctcaataatagacaggatttgattcctttttgtcatgagaaagctccctgattgtgcatttgtaatgcatgaattgcacagatctccctgctgagaggcttacatcacagagttggctcactgtttccagtatcattcttccagcccaacagtaagcactggcagagagcaggtagctgcctaccctgatattacgggacgtcaataggctcttgcacgcaagtgtggtgtttttcattgcacaccaagggttattaggctgtgctgagtcagatggaaataaaaatagcctggaacctgtgcccgtttgtttgggggacttgtcccagcaccatgctaatgagcccaagggcttgggcttgatgtccctggtggttccatcagagcaacatgaaggaaagcaactgtcggaagccacaggccctcacttaatgtggtttgcagagtggtaagtgatggctcttcccacgggtatggttgtctggcacagagagagccgggggacccacacgctcacgcagttcctgccagcaactgtgagacatgacgactgtgacttagcagaatccagggttcatccaccctcctgtgagtcctcctgctccccgttttgctgccatctcgggccaatatctgcaggtgcagagaccctggagtagctgcacctcagcctcatgtcctctgtggtcccttaattgcccaaaagaaagaatttaaatgtaaagtcgctctgtgcagcgagcatgttccttcgtgccctgggcggcctctctgacagccctgactctggtctgtgacgctgggattgtggctgctttcaggcaccgtcatggccttccatggtcctctgtctgcctttgtctccttccttctgtttaggatgccctttagtgggggaactcctggtccgccttcttctctaaatctgtgctctctaccaaggattttccaagcctgcgcttcctcctgtcgtctcctttgctcctctccgtggctctggctcctgttccgcagcccctggacctatatctgtgatcacacttagtgttttatacatcagttattcacttaagtgtcggccgtgcccaccagcccagaagactcaaggacgagtacttttctatacttacctttacacaagatagggtctcagtactcatcgcgattaatacatgaatgaacttcagcaaaataattgcaatgtgtaaaggccaagatccagaataaaacctttcatttcttagctaaaaatctccccacatccattagttttacatccttggcattaaagatcctaaggagaaattggtattcctgtctggaaaaacttgctgttacttaatgtatttgaaagtaagttatttttaaataaatatgaaaccccatctctactaaaaatacaaaaaattagctgggtctagtgatgggtgcctgtaatcccagctactcgggaggctgaggcaggagaattgcttgaacctgggaggaggaggttgcagtgagctgagattgtgccactgcactccagcctgggcaacaagagtgaaactctgtctctaaaatatatatctatgtatgtatgtatgtatgtatgtatgtatgtatgtatgtaagtatctatctatatatctccatatatacatatagagagagatatatagagatctatatagagatagagagatatatatagatatctatatatatctctctatatatgtatatagatatgtagctatatatagagagaaagagacctggagaacatatatactcaacaggtgcatgtcataaccttcggggaaatagggtgggaaggatgaagatgatattttatgtgatctgtactgtgtgagttgtgagtttctgcatatattaattagtaaaataggtaggagcaaatattatgaaagcattaaaacaccaagactaaccaagacaatcatgaagaggaacatttctgtctaactagatggcaacttattataaagtcttagtaattctgatgactataccccacatggatgcagagacagaataagtaaatcagtggaccaaacagaaacaattggtcatatttacacagttcttgttaccagctgggctgttttaaacaactttccaatataaattcatttaatctttgcagctgtccatgaagtaacgtttataggtctccatttaatgctttaagaaaatagaaaaagaaaggttaaattgctgaaagagtcacataagaggaattggcataagagacacaccggctactccctgggtgtgaagctttatagccacagcagggaggggagtgtcaagaaccagggcagggaggataaagaccccgctgagagttccagctcagtttatgattggtatatgcctttcataagcaagtcactattttcttgaaaagaaatggaaatcaagagatgcatgtgttgtcaaagcgggagaaaatatttgcaaactatgtatctgacacagtactactatccagaatgtacaaggaactcaaacaaatcagcaagaaaaaaacaaataatcccatcaaaaagtgggctaaggacatgaatagaaaattttaaaaagaaggtatacaaatggccaacaaacatatgaaaaaatgctcaacctcagtaatgatcagggaaatgcaaattaaaaccacaatgcaataccaccttcctcctgcacaaatggccataattaaaaaatcaaaaaataatagatgttggcatggatatggtgaaaagggagcacttctacactgcttgtaggaatgtaaactagtataaccactatggaaaacagtgtggagattccttaaagaactaaaagtagatctaccatttgatccagccaccccactactgtgtatctatctacccagcagaagataagtcattatatgaaaaagacacttgcacgcacgcctatagcagtacaactcacaattgcaaaaatatggaaccagcctaaatgttcatcaaccaaggagtagagaaagaaaatgtggtatatatacaccatggaatactactcagccataagaaatgaatgaaataatggcattcacagcaacctggacagagttggagaccattattctaagtgaagtaactcaagaatggaaaaccaagtatcgtatgttctcgcttttaagtgggagctcagctatgagggtgcaaaggcataagaatgatataatggactttggggactcggggggaaggctgggagggggatgaaggataaaagattacacatggggtacagtgtatactgcacaggtgatgggtgaaccgacacctcagaaatcaccactaaagaacttacccatgtaaccccaaaccacctgttcctcaaaaactattgaaataaacataaaataaatttttaaaaaagagatacatgtgttgaaatagacaataactctcaactgtaccagaacctacacctccttattttggcaaattattttaatgctcctttcctaatttaaattaaattcataggtgataaaatgtatatgcatataccactttaaaagtttcaatatataggctaaataaaggaatgaacttataatccagttatctgtccttcagcgtgtcactgctcaggtcctgcttgccaggtggtctgcagctagggcactgacatctgtgatgaagtcagaagcttcttcctatgtgtaaagagtaaaactgggtttaaaatatttttttttaaaaaaaaggctgggcgcagtgcctcacacctataatcccagcgctttgggaggccaaggcaggtggatcgcctgaggtcaggagttcaagaccagcctcgccaaaacggtgaacccctgtccctactaaaaatacaaaaattagccatgcacagtggcgggtgcctgtaatcccagctactcgggaggctgaggcaggagaatctcttgaacctgggaggcggaggttgcagtgagccgagattgtggcaatgcactccagcctgggtgacgagggcaaaactccataacaaaaataaataataaatttttaaaaagcagaccagaaatagttccatataaaaaatataggaaaagggaagagcagataatacagaagaaccttagaataaagcctgagattaagtaataatagattagttttattttgaaaatgaaaagaaaatggggacacactccatttgaaatacaggatgcgtaccaaggtggatcacagattgagaggagaaaatgtgtgagattctccactgatagccaggtgtggcttcttctttttaagcatggcgtgaaacaaattatgacatggatgatgagggcatgaagtgtccctgggatcctaccacctgacaaggtgtaccctcagtctccaatgcttaataaatgccttgtaaactgtaacctctgatacttaatgaggaatacagcgctttgaaacagaaaccgaaataggtctctagagaagttgtatgataagatcctgggggcagtgtcagaaaaggaccgaaaaaccacagattcctccctccaggaaataatttcaatacttaaagtttaccatgtagatttcttgttctggtgctataattgtgaagcatataggaaacactataaaatgttttaaaacaatacttttgataaactttattaagacctctatgtttcatgtgtttgcactaaaaataatgtttgcttctaagaatgttcctatttgactaaggtgatttaaaatgcctttgcattgttgcactgtttgtgtagtgattgtaactctgtactaaagccaattaactttgtagttggatgggttataaaatactcactagacacagtactccatagacaccatattcaataatagacacaatgtgtagaatgaagaagccagcgtccacctctgcaacgagcttgtcctgaatccctggaccctttatttttcatcccataaaaactttcagtatcattatgtactgaagtactccttatttatagttctgtggatttattccaacgagtctgttgaaaactgggatgtggggcacctacacttctcaccgtgcaggatctctacccattgcagggtgtccagccccctggcctctaccccaaatgccagtgaagtctaggattcattgtgacaactgaaaaactctcctcatttcaaaaatgcttcctaggaggtagaatggccctgttgagaaccttaaatagattatagattttatttattattattattatttttttttttttgagacagagtctcactctgtcaccaggctagagtgcagtggtgtgatctgagctcactgcaacctccgcctcccgggttcaagcaattctcctgcctcagcctctcgagtagctgagactacaggcacgcatcaccatgcccagctaatttttgtatttttagtagagatggggtttcaccttgttggccaggatggtctcgatctcttgacctcatgatctgccctcctcggcctcccaaagtgtcgggattacaggcatgagctactgctcccggccaatagattatagatataatttttctgttattatttctttcacaaaaccctggctgtacaagtatcctctgtaaacttagatatttccgacagtgtgtctacttccttccttcatgatctcaactctctgtaaattacatgtgaatgcattcaggactgtattttatatatcatctctttcatgttttgatttgctttttccaagcagacattaagtgtgctgaaggtagttgtgttgtcatctgctttcattgaatccttcagaaattttagcaccacaatgagattctgaaaaaagcacagaaaaggggcttaatatagaatgtttaaagaatatttgttttctcaatttatattacgactttcaaacttcagtgcatatgtacacacacacacacacacacacacacacacacacacaccattttaaggcattgctagactcacatatatctttcaccttgaagatgaagcaagattccaaaatgtcagaaaatcttgaaagtgtcttagatacgagcaatatggggagagagccagcaactgagttattcccaagctcatttagtgacaaagttgtgggttggttaggcttgttagagctcaacaaagcacttagtgaaggaaatatgaaaattagaaaccactgtaggatataaattaagactatttggaggctagaaagatttggggattttttttgttgttgttaaaatatctagccaactcctgaaaaataatgagtggttgccatagcaactgtgttttcgcttgacacacgaaagaacatgaaaagcattggaatcaaggaaagccacctggttttagactttaattttggagaaacaaattcatccaaaatgatttataaaacaaaccctattttattttccttccaaaatgattgtagattttttaaatttttttaaattcaaaacattgagggtatctcaaaggaagtgaaaatacattcttttccaaaaaaaaaaaaaaaaaaaaaaaatacctgggccgggtgtggtggctcacgcctgtaatcctagcactttgggaggccgaggtgggtgtatcacgcggtcaggagatggagaccatcctggccaacatggtgaaaccctgtctctactaaaaatacaaaaattagccaggctttgtggtgcatgcccacagtgagctgagatcgcaccactgtactccatcctgggggacagagctagactccatctcaaaaacgaaagtgcctggtcgtctttccacacaactccgtttccactcccataaaatgctacgttagctgttttgagggtagatgcccttagactgccaactcacaaagttttattgggcacctgttacctgttcagcagagatttgtaaaaaaagacacatcaggtggcctttgcttgcaagaaatcagcctttggaacctgtggagaaaagttaagtactgcgtactgcgcaaatgaagggtgggagctattgaagggaagagactcaccccgaaaacccaagaatggtcaaacgagaggcaaggtggagcctgcagttttcactggaaggattctagagtgagtgattctggggacctagagatgggggataacgggtgaaaggaacaagcacggcccctttgaggtggaaaacagactggtgggccagggttgggagggtgtgctggggaagtgttgtgggcagaggctggaaaatgaaattgggctggggttaggagacaggtgaccgtggaagactgctctgacaatcagagtctggactttgctcctctgcaggatccctgatgcccagatggacccttcgatgttcctggcccacctgcgctacctattcttgccccgctctgctctagtatttacaactgcacgatggcacagttggtctctgggacttagaatttgtgttgcaaacacaagacctggagaatggacctggtctgtgatatagtgtgtcagtcagggacctggagaaacagaaggggatcccaaataagaagacttgaaggaagtttaagaaaggcaccaaatacaatttgaaacttgtgggctgggaagccacacgagatagcgcaggctgggggatgtgcaggagctgtcatcagaagccggaagtggaacatgttatgaaaaaggtcacttttcataacactttgcatggagaaggagtacaagggaagtcaagaggacccacagtgggaagtgggctgtgaatactctgatcctacctcatttactgccagtgcatcccttggcctaagtgaagtaggagcttgggagaagattggccgttgactctaatcctgctcccaggttcctacttaatcagcatccaagatcaaggtgtggagttgacagtgacatctcggacttcaatccaccatgttgacttctgattaaccccagtcctgggaatacctccaagaattctactttatttacttctcttatgtaagaatgtttaactcaccatggatcctgcccttagaccaaagcgaccttgatgttattgcacaaattacaggctatgacacatataccattcctgcctgtgctagaggattgcctttaattgcttgctggagcacatatgcttttccctatggtagataagccttgggtctgggagtaagagtgcagagatctacctgtcttggtgccacccaaggtcatacctccgtctgtaagttcccctttcatggaacacaaggtaaacctcacaaagtataaggcagatcttttcccatttcctgcatgtcttctcaatacctgtgattgaaacatgcagtggaaatatccatgcccgtcttgatggatgaagctaactggctggtaggtcgaagccagttcgaggaacaggctaggaggtctgcatggaacctgggattggccatcccctcatgagggctctaatgggaagatgatgccttgggtgtgcctggatgctgagaaaacatgagatgtgtattaccttctgctctctgtatgtaaaacagctgaagctaaatcccttgagatgtttctacatccatctatacctagatcttggaaattttgcaaataagcagttgtcagaattttgagctatggcttagggtattaaaaaatagaaagacaagggaagagggtgttgatggaggcttgagccacttagcatgacctagcccctgatcagctgtggttagtccaaatgagccagtatgctggggcagagagcaggatggagtagcaaaggccctgtagtgaggccctctgtgggggatgagtgtgcttggtagcagtttgaagcattgtgcctctctttcctatgcactgtgatcagtgcacaggaatgtagaaagggccaagcctttcaacaccttagactctgatgcctccagggtggattcactgtgccatggaaaaccacataacatcatcctattagcgtacttttgagagtagatgtgctattaatgatgctaaaacaacagacatacactaccagaatgctcctagcaaaatgaggacatgtagtcaccctttcctctgctccctccccaccacctgtgccattagaagctggaggagggagcggtcactgtggcatggagtaggctgggcaatgaaggcttctaggaaaggcgggccttggttcatgatccgtggtgggattcatgtgggtaggagagaaaatcaagggacgtcaagagcgtggtaatagcttgttactacctggggagaaacatatctgctagagttgccatttagagacatgtcaaaacctccagaaagtgtgtttcaatgccaagtgctaattgtaaaagggaacgtgtctttctgcagttctagtttgttatagaaagggacagctcttgacgttagcaaataaggttgtatgttatggatcctgtggcaactgagtgtatgtgacggaaaatggatgtttactttaaggtcattactgaagactttctggagccacctctttcttggggacgtctccctactgattcatattagaaatcaacttgagtgacctttctcttcaaaacatcagagactgccttggactgtgtggtctgcttggaggacttcaaccctcttagaaccttactctgcatgtgaacacagcagcacaggggcagcgggttccatcgtctacgggagatggtgctcaagggttggagccagtccccctagagagtcacatagcatttggccctcgaccatggctgaataaatgaatgaataaaccttatttaatatatactttcacctgcctgagttgtagaactctgcagaagtccttttatatctcttctacattcatcttcagagccattgtatcataggggttgttttgttattctccatacatcctaatttatagaggagaaaacgaaatccagggaaagctggaaaattgatccagggtcaaacactgaacttatggagaggatggagaggaaagcgtggcttttggagtaatactgctgagagtcaaatcccagttattgcagtgaggagtagcaagaagtcacctaatttcaacaacacaatcatttcaggaatggaaagaacacccccagttccattaaacgacatgaagtacagaaagtcctggctcacagaaggggcccactaagcattagttgccattcctttcttaggtaaccaccgcctgtggaccctcaccccttcctccactgtcagaggcagcataatggctcagtttgcatttcaaggctgatagaatcaagtttgctaatgctggtcctgctgccacctagaactcccttaatgaaagtcagcctccacaaaccttgaggagtattaaaggacagagccctgtgaaggatggtgctgtgtgtgcctatcttttctttttcttttttttttttttttttttgagatggagtctcactctgtcacccaggctggagtgcagtggtgtgatctcagctcactgcaagctctgtcttctgggttcacaccattctcctgcctcagcctcccaagtagctgggactgcaggcgcccgccaccatgcccggctaattttttgtattttttagtagagacggggtttcgctgtgttagccaggatggtctcgatctcctgacctcgtgatccgcccacctcgacctcccaaagtgctgggattacaggcgtgagccaccgtgcctggcctgtgcctatcgtttaactgactagttggattagtgaggagtcggttagttgttgtgcttctttgcagtgcactgggctgctacatggacctgattttgactacctgttctaagggatgaggaagccctccttgcagaagcccatggaagccctccttgcagaagaaatatcccagccactcaggttggcagactctgtgcagaatacccagtgtctttcctcctcttatttatctctcttcaggtaccaggaagtgaaagaggcctatatacatggaagttctgaaggagaatagcgttgccatcctccctacccacctctgagtctctggttcctggtcacccaagcctccatcatgccctcttcccttctcttccttttattttttaataccctaagccacagctcaaaatgctgagcaccacttctcttcagcatgactgaggtctaggtatagatgggtatggggacagctctagggacttagcttcagctgtttcaaataaaggaaaaagcagagaacagggatctcatgttttctcaccagccatgcatgcccaaggcatcttcctatgagagccctgaggagggaacggccaatcccaggttccatgcagtgcctccagcctgttcctgggacaggctccaatctcttggtgcagttagcttcatgcattaagacaggcatggatatttccatgttcttcctgaatcacaggtattgagaggaagtgtgggaaatgggagaacagctgccttatgaatcatgaggttcacctaaaccttgggggctagaattgagatggagcagtgttctgaggggtcccaagaagcctagtataactcataagatgcttgggagtttaaatatgcttttctgtgcagagtctaccatctaagtctctctggtttgaagttggagaaactgaatttgtcattcagctagaaaacatactggaggagagattttaactcatgcctcagaacaaagctcagggctttctgaagcaccagagggtgccaaaggagtcagagcttgggttctgcccattgagaagaatgaagagggatgctggtttcagtttagcaggaggaaaatggtaaaaataacattgaaaagaacaaatagacttacaagggttctcaagatttatctgcaagtgatattttctaaggagactgcgtgtgtcccccaaactccattttcatcatgtcacatttttctcaaaagcatttctataattctagcatgagaagggaagccttggtctaaatgttcatgagcggaaccaagccgcctttccagcctcatcctgcaagcacatactccctggctgcaggtaggtcccctggtagtgtgtagatgccagcatttctgttttaatggtacatggagagaggcgatctaacctaacaacaaattgatgatctagcttgaaaaaaataccaactgccatttctatcaccgtaatttcaaaagcagaaggacattttaacatcaaaaagtgggaaaaacattttcagaacaaatatcatggctccttaattttaaaaagatgccttgggtgcgttggctcacgcctgtaatcccagcactttgggaggccgaggcgggaggatcatgaggtcaggagatcgagaccatcctggctaacatggtgaaaccccatctctactaaaaatacaaaaaaattagccgggcatggtggtgggcgcctggagtcccagctacttgggaggctgaggcaggagaatggtgtgaacccgggaggcagagcttgcagtgagctgagatcgcaccactgcactccagcctgggcgacagagcgagactccgtctcaaaaaaaaaaaaaaaaaaaaaacaggtgcctttataaaaccttgttgtatctctttttcttttgttttaatttaccacaaattcagaagagcttcattatccctagagtaagaaagggaaagaataaagaaaaaaaaagagcttctttaaagaccagcaatccgtggacaggcatttagcagttactgacttagcctacacactgggctgatatagtttctccatctggaatgtccttttatctttcattttatccaattctcaacttcttttccatcccaaagaatatcccatcgccactctcaagcttttccggacattctgcagtaatatctacctcatctgaactgaaaactctcttgcctcttgtactcaattggcctttaccgttcactgtcttctgacatctcttaaatagtgatgagtcattaatgcatctcgccaactagacagtaagcattttatacctctttttaatgtctattattttcagaaaatatgtgatacctaataagtaagtttttaaagtttgctgaacgaacacagtaagttctttgttgtactccttgttttctggaactgtgatgttgtttatgtcgagtcccagaagttaaggcagaagggaattgagaaactgaccctgaaattatgtcataaaaaactgagagttaaaaaagaagccatggctttctattgcaactttaactttcctagtatgcttagtacttattttttatttttatttatttattttttgagatggagtctcatactgtcacccaggctggaatgcaatggcacgatcttggctcactgcaacctctgccttccaggttcaagcggttcttctgcctcagcctcccaagtagctgggataacaggcgctcaccatcatgcctggctaatttttcgtatatttagcaagacagggtttcaccatgttggccaggctcgtcttgaactcctgacctcgtgatctgcctgccttggcctcccaaagtgctgagattacaggcgtgagccaccgcacccagccagcatttatttctaagccaaatcaaaatatagacctttgatgaaggtgttaagaaaacattgcattgtcctggttatttagagatagagacataaattctctatgattatttctcccaaagatcttggaatccaatggatctgagtcaggtcaagatgaatgaatacaaatatgagaagggcatagctcatcagaaattcagagaccctgggtgagcagggttaggcaacttggagaaactttctagacacaggagccatagcactgtaactaaagaaggaggaaaacacagcatgccgagcagggtatagaggctgcaggtgtgtttttccttggctttcatgctgtgctggccctgacacaggactgactttacccataaagaaagtggcagcagcaggaagggcactgtggtgagccctggtgaatccacatggcacttggaccaacccctcagacacaacccctttctcattctgttccatctgctgccctacacgatgttccatttcagggctcgtttctgagcatggaccagttgctaggcacagttctgcagatatacagtgagcagaaacaaccacagagcttactcttttttttttttttttgagatggagtctcgctctgtcacccaggctggagtgcagtggcacaatctcggctcactgcaacctctgcctcccagattcaagcgattctcctgcctcagcctcctgagtagctggcattacaggggcccatcaccacgcccggctaatttttatatttttagtagagacagggtttcaccatgttggccaggatggtctcgaactcctgacctcatgatccacctgccttggcctcctaaagtagagcctacttgtatattgctaagggcccagtgaagaagccagggatctgttaaatatctcacccacacatataacattacacatctgaggactgttgtcaaatgaaatgatgtggttcagggagaccaatgagtgggatgtggctgctgagaatgaggtgcagggtgatgttacatatttttttcccaagaaagggatgtgtaggctgacagctaaagtgtcagtaggtgctcactagtttggaacagaagagaacattgttcatgcaaaggaacagcccgaatgaggctgtgggacaggagggagtgtcacggggctgacagaatgcccacttggctggcacacaaggaagggaaaggagtggtgtgagatgaagctgagcaggtgtcagcaccaacctcttgggactttgcagagtatggcacagattttagcttcattataagagtagcaggaaggcactgaagagtttaaattggcaagtaatgggagctgaactgtgcttttcaaagactactctgtctgctctctacagctgaagaaggactgaatatgggttggagggagagagtgagagcaagcgtagctgggagcaaacatggagtgtaagagcagaggagagaattagccgcaggccagggaccttggaaggacacttctcactaaaagccacactcagctagagagcctttttaacagtgagtgattgttcttctctggtgtttctctctgtccgtccctaatccaagccaggagagaatgaaggctcttagtttaaaaggtcctctggtcctttgctgccccgttcttgcttttctagccagacatggttctctgaggatttgttaaattttatagcccagtggtcaagtaaacatggggtggtactcaaagaaactcacaggtatttattatccaaagctactgcatttggggattattaaatacagacatatagacacatatgtatgcaaggtcattggagtgacatcccatcctgagaacaggggccaccttctacaaatgccaaaaatgcacttcgcacagtgttggaaatttcatcgggtgttcactgaatgcacagacctgctgcagagcctggttcttgtgtctcttgtcttcctgggtgtgctgggatggaggacagattcttatgtccctcattggaatctaccctctcagccagtcttgtgaccacacttttggagtgatggagtgatgggaagcccctcgtggcacagcacctgccccagcaccattggctgaaacggaaacaaccatccacttggcctagcagagtccttgactatcttttagggctttgctctgggaggggctgtgctctctgcctgcctaatatccccacttctggcccagtggggcttgggctgcagtagctgcattccattctggcccatcacgtggcaacaccaaccacgatgcctgccgttttccctgagatgttctgtgccctctcttctgagacactggtggctttctgagaactgctgtatggtgaactccatcttcaagggttattggcttccaaacaccatgacttgcgggagccccgttccctgctcatcagtgtccatgcaattcaggcaactctccccagctatgctagttacttccttcatctaaaccctgtttggaagccctgaagttcctgcctggggaagtcaagtaaaaatgggaggtatgggacttgatagcagcagatgtgcaaaggtcttacaggttacagttgagtctcagtgtgagatgggtcactgggggatgtggcccctgggcagctagtgctatggagtctgtagaatagaggcacagtgatgaccagttatctctggagcactgtgctcagttctaggagacacatttttaagagaaactcgtgctttcctgaggaggtctgggtctgtgctctctgatatacggtagcctctaaccacctgtggatatttaaattttatgtaattaaaattaatgaaaatttaaaacagttgctctggcactggccacatttcagatgaactggagccacatgtggctccggctggagtgtcaggcagcacagtggagagcatgccctgtcctctggaaggatgtggctcagagcacgtccagcccagaagtcacagagccaggacctcatggagtgagaagtagttgaaaacactaaagttgtgtaccctacaaaattgtcctcagacaattcagaatctatgtcacagaagcagaattggatttctcaagagtgactcacaacagcataacttggattaactgaagggatgtaaagagaaggttttagctcaatgcaagtccaacatttccatcagaagtgttcaaaacgtggaatgcgagtctccaggaattgtgatttttttctttcgtttaagacgttcaaatagagactgctgtccaattattgccaatgctagggagggcatttctgcctcagatggaggtagtgaggtgtcagcaaagaatgtggattttagaactaggtagatttaacccaagtcctggttctatcattttctaacttaatggctttgctcaactcaccacacccctccgttctccccagtaaagtgaggacaatactaattgtctcacaatactgtgttgggtgttaaatgagaccacaaagtaaagtatcaaaggcagtgcctgtcccagagcaggtgacttgcactaatcagaggctcaccctgccttgctgctccacacacacgactgactgacaacatccgtgacccacaacatccacagctcattcccacggcagtcctcacgcaggcaccaaaactctaccccactcatgaaatcgacgtgaaatgcaaggaaatcagaatgtggttatctgaggtatcgactttaatcttctctggtttatttttttaaataaattagttacagagcgagactttaatcattatcagtagcagatttcactagcacaattatcaagtgtcaaaaccccaaaggtgagaatcaccgttcttggagcatcctaagccctgtctacctttagaggttccaatgctggcatagggttcaagaccatatgttttattatgaggaattcaagtgagaccagactgttttgttgtaaatactataagaaagacaacatcctttcttctcctccatttctatgcctgtgaagatgtgatgagcaagccttggaagcctcagttcctcagactcttccaggcatggggccatggaacttggcaaaagcgggtgctgtgtggatctcagtctctggagccattcgttgggtcgtgagcagcaaagtagccttcatctttcccagtcttcacacttcgaggaccctcactgctggtggggagggggtttctgctctaggctgtggtaatgctatcccccgacctgcaaattcacacaatgagccaactggccacatgctccaaggagctaagatgctgttggtccacaaacaaaggttcaggttctgtgtagcttaggatccggttgctaattggcttgaaacatttaaatcctcttgcatttagttgaatatgtggatatgcctattgagaagtatgttatgaaatctagggtttgtattcccatccgtaacaggaagaataaaaccttgaaaaatgtttcattttaaatacagaccccttgtgtatcaaaaagtatatttttttgggaatacaaagccaccaccaccaccaccaccattgcccatagaggcgcctgcagaggctggacttgctgcttctggtccgttgagctgagaagcacagaggttcagtgggttgttgagggcaccagggaccccaggtggaactggtaagaaaagctgaatccaatccttggcttttactcaccttgtttaaattactgtccttaagctttttccatattagcctggagccataaatagtttgtgtggctactttcaaaattcaattctgggccgtttgcggtggctcatgcctgtaatcccagcactttgggaggccgaggcgggcggatcacaaagtcaggagatcgagaccatcctggctaacacagtgaaaccccgtctctactaaaaatacaaaaaaattagccaggcgtggtggcgggtgcctgtagtcccagctactcgggaggctgaggcaggagaatggtgtgaacccaggaggtggagcttgcagtgagccgagactgcgccactgcactccagcttgggcaacagagcaagactccttctcaaaaaaaaaaaaaaatcaattctgtgcaattcagtcgtatttattgggaagcctttaggttcccagaagaactgagccaaccttgaagggaacaggaaagaaacagagcctgtgatcagtgggcactcacagcaaataggaatcctccgcctcccctgcttagaaacctccagcaattcctcaggggtgcaggtagaatctcagtccagcagccaagggcttacgtattttgagcggtctatggctttctgttgagcagacttatagcttctcatagctgggcatatttctatttcctgggttatctgaatgcatttcttgtaaccctggcagaagaaaagtttctatcagccctccttgtaggaagaaaatgtgttccctagtttgtaggcagcagagagcctgctgtgttagttgtgtcccgtcagaagcatttgagaaagtctctcgcggtataacaatggcagttttttgcttgagggacagagagagagcagaagctggtgaatctgacaggcaagggtccctaagagaaaggataaggtccctaagaaagggccccctgccctgccttcctcacctcctcttccccccctcaccacgtggcctcaggagatagggcggtgtcactgcctctgctgaccctcccgatgtaccagatgaagagaccgggtcagtaacgcaaggagttgatgtggacatccactgcccagcattttgttcatcgtgcagctttataaactgtccaaagcaaggttcagaagaggcaggattttgcaaaactctcacatcagttccatctaggacgtgtggacatcacagtgattgggatgatgggctggctgacccttggtggttctcaacaatttccaggatgttgcatttatttatccatgacatgacatcaggggtgggagctgtgcttatgcagaaaggggttctcacagactggaccatctgcctacctgctctcccacctgtgtattgtatctgtttatttaggtggaattttaaatttagaaaacagttgcaaaaatactatgacctgtttatatcctttactcagatgaccaattgtttacattttgctccacttactttattattttctctctttctgtatttaccaataaaaagagcattttcttacagaggcacaggaccgtgaccagaatcaggacattcacagttggcacagtatcggcgtctaacctggcatcaacattccagtttcacctgctccctggcacactgtggaccactgccaccttggtctgggatccacccaggcctccagtgtgtgtagttgctctgtctccttaatttcctttcaactagaatatttcttccctctttctttgcctgttatggcctttacatttttcagaacagaacaggttttctgtacagtgcccatcactatgatttgtttgatgtttcctcataattagaattttggccagaatcctagagaagtgatgttttgtccttgccatgcatcctatcaagaggcacgtgatatcagtgtgtcctgctggcgatggtcattttgatctcttgtttaaggtggcatctgtaaggttttcccaccgtaggttgctctatttcctttgaaatgaacaagtaattgtggggcgattttttcggactatattcatatcttttgactcatcaaattttcacctcctagtttgggcatgcattgatgattcttacccgagtcaagtattattacaatggttgtcagatggcaatcttctaatttcatttctccgtctgcgcccatcagttggcattctacaaaaatatggagccgtcgtgagcttgcgtctccttgtgcaagagctgtggctatgctgagcttctccacatatttccaactttagtacatgggcaggtgaggcaagcaccactcttaccttcgaacaccacacacacacaccacacacacatatcacataatacacaccccacataccactcacacagcataacacaccacataacacacatcctacatatgacatcatacatcatacacaccacacacacaccaaatacaccacatgccacacaacttacataccacatcatacacatcatacacacgacacacagcacataacacaccacatgccatacatcctacatacatcatacacaccatacacacacatcaaataccacaccacatgccacacaacctacacaccacatcatacacagcatacacatgcatgacacatagcacataacacaccacatgccacacaacctacataccacatcctacacaccacacacaccccataacataccacatcacataccacacacaccatataccacatcatatacaccacacacaaaccacacacacaaatgcaaacaccacatacaccatacatacccacacacacaaacactgtataccatacaccacactgtacacaccacaaacacacacacaccataccccacacacacaccatacacacacacacacacacaccatacacacacacacacacacacataaaaaaaaacttctgttgaggctgtgcccccaccacttggagccactacatctccctacctcaacttctttccacttggtagtcctgtcttctgaagttagtaaatgcaggcgtgaggcagggaggcgctttggctgattggcggaaccctgggatgagccacagcatggctgtgtggcacgtgtggtgtgggtgtgggtagggggatcccgccgtgcttccttcccaccctgagtcccgtgtgtgccccttacagtgtgtttcctattaaagttcctttcatgtttgggccaagggtgtttcctttaattcctgctagcataaaagaatgaggttttctgcagcaatttctaagtctgaaaagggaggctctggggtaaaaatgttgaacaattaaaatgattagaaattatctatataaaatacaggtatacaaaatatgtatattgaatcctagctagacagacggtatccccgggagaactcctccttgaggaatgggccatttgcttcataatagatgcgagatcatcctcgggccagttagcatgcacagtttcccgggatgctttgcgatacaaattcataaacattgattgaaaggtcaggggacgttcccatcaacacgcggctctgtcggattgttcaagggaaagttagcactgttgcatgcaggcagttgagttcttagggaagagtgctggccctggtggagttttccatgtctgtgtgatttggtgtggtgtgatatagtcaatgggacttggttcggcgcagggagagctgcatgtttctgctcatgttatctggaaataaggattcgggctctgtgtgctgaattatgtttgcggcgatctcacagttgtgaagaagaggcatggctgggaggcatgttcagagctggagagggtataaaattctcatttcttaccttctctgagggaaggagtgtggagtggcagatttccagtctctgggtcttatatcagtgtcgttctctgggaccagcactgtccccatatgggtaccactgggacgtgtagttgacctctgacgtgcacggcagatgcacggacaggcagggtggtgctgggtgagcattagccgtgtgcagctggtgagcctatgccttcttgttggcaggcctcgctgctgagagtaagttggtgaggacccatgcacgtaggttctcacatgtttccaaaggtcccttcctgcctcactggtgagcctttctcccaaatgagaactcctcgctcttgcctccctttctactttctacatcttcctgggacttcctggccatctcctttctgcatgcatgctgcaggaatttccactccagggagggagctctcagtatctgcacagcccaggtgcaggacatgtgctgcccaggctgggttgctgtctgttgtttcaccctgcacagtgaagagaatggggggttaatgtgtcaggcatggcatgcgtgatttagaaccattcatgcctccaagtatttgaggcagctcctgggatccacatctgtgagcaaggaaactgaggcctggcttaaatcacacgtccaagaccagagttaggaacagggcacctgcctggacccaggttcacacctgtaagcatgtcgtgggtgtgggatatgccttagctctctgagcacgtggcagaaatttggggatctatcacccactaccgtaactgtgacaacgtctccacaggaggagcggcaaagtctaaattaaaagaacgtttcccgcagggggcgctcttttttggatctctctgcttggagatatctctgcctgtgtaggatcaaagcagagggaacctctgtgttttcaaataatgtttttcccctaaagcagcaccagtcctaattgagtaatagagtaacaagaagtagaaaggggaagctttagcagctgggccttcacctggtcttccaacaagccccaactcgacgagagccaaagcaagagacaccatttggaggggaagataagaagtcttcacaaggtcttttccggtgttctgctttttcctgggaggcggccttggcgtgtccctgagacctcctgtgatgctcacggctctggcgctgccatttttcttgggtgtcgtctggtggtgtctgcaaggccagctataatgtcagggctgtgctcgatagcacagaaaagacagcgtcctggaggagagcttgttggagcagatttacaagggagggtgtgggtgtcactcacagttcacgctacaggacaatccctttcactctgggagctgagtcccaggtgagagctaagttccaggcgagaccagggagtcgaggggactggatttctgcttctctcccaggagctgcgggctgggaaggggaaggaacagagctgaggtgtgacatcgcccccggtttcccctgttgcccaggttatagcttgggtggggctgacttcagaggcaacattagaaccttttaaaatacccttaatgatttacatgaattagaacaagaaggcagctgggtgtcgtggaaagcgagtgggatctgggttatgtcctcactgtgcctttttatgcacacaaagatttatctacccatgctatcaacttagtgtgtattatagtgaaatgccgtaaataatctcatgtcccctttatacagataagaaaaatttttcagggacattgagttaacttgataaagttctccagttatcaacctggtaattccagttctagaaaatggcaagaggtaaatgccaacagtgggtatttatataagaatgattatggatcagttaagcaagtcagtaaaaggaaatcgctagtgtgcataaggtgctattgaggcaatacctttatgcttttggtttataaagtaaaacattttaaatcttggtatttgtgctatgtctgcataataaaatatttcataattaaagtcatactttggaagattttttattatataagaaaatctctatattacaacattaagtgaaaacagtgggagaataaaatctaaaactacatatagagaccaaatcttataaacaatagattaaaaatactagtaaaaatagtataatgactatactagatttgctgtctctgtgtgtgaaattatgattaaatgatttctagtttatcctttctatattattccagatgtttcactattaacatcaattatatttataacaacagcagcaaaggtcaacgtgatttatatttttagaaaaccaggtattagtagttatggttatgtagcaaggctggctcaagaaatggatcagactctgagaggaaagacccacggttttgttgggtattcaccgtgtgctccccttgtaggtagaggtgatgggatggacctggcgttcactgcagctgcctgtctccacactgcacagcctgctttggaggacgcccagcctccccttgctggcctcctagcagtctcgtcagtttttcctgcaatgtgagtcactccctttgctgtagcctgggtgtacctggaaccagccaattgcatatccacagtcaggcggccactcagtctcctaccagagtttacaaagccagggtcctacaaacaccctcataagtgggcttattttggcccatcccatgaaagaagaggctgagtctgacaacagcaggagcagcagcaatgatcgcttattccgaggcctctatgtgcagggcacacctccactctcccgccgtgctgcgagccctttgagggcaggacccgtctgattcaacgctattgctccagcatagctggacagggcttcacactggacatgctcagtaaacttgagaacgtaaaacagatgatcgaattcctctgtactccagatgattttgctaaacagaattattacatatttaaaatacaggattatcactatttgaagatgaaattagacacttatataataaattaccccaacacttagtggcttaaaactatgcacatttgttacccacagggtctgggtagcagggatctgggagcagactggctggtactctggctcaggccttccaggagcacgcagctagtgctggctgaggcagctgtcacctgagggcttgtggaggcagcagggcaacgtccaggctctcttatgtggcctctggcaggaggcctcgggtgctagccacgtaggcccttcctcatgatgtggcatttggattctcccagaacaagtgactgagggagtggtgggagggaggttggtggagacagcagcgtagccccttcctgtgatctagtcttatgggttgtgctcgctcacttctgccatatacattaggagcaattcataaaatccagcccagacacaagactccacctcttgaagggagaggtattgatatggttctgctgtgtccccacccaaatctcaccttgaattgtagctcccataatcctgttggattatgttggaggagggaccctgtgggaggtaatttaatcgtggagatggttaccctcatgctttctcatgatagtgagttctcacgagatctgatggttttataaggggcttttccccttttgctcagcacttctccttcctgctgccgtgtgaagaaggacatatttccttccccttctgccatgattgtaagtttcctgaggcctccccagccatgctgaactgtgagtcaattaaacctcttttctttataaattacccagtattaggtatgtctttattagctgtgtgagaatggactaatacaggtatcaaagaatttgcggtcatcttttttaaaatcacaaaatttcaggagatttaattaataaagtgagactcaggtctaggcaggtaattagaggggcctccaagaaggaaacaaagactttgtctaacacactatggtctggagacagatctcctaggggccttgctcagctttttgcttacagcattgagctccagggattggctctgcttgccacagggtgatgtgccccatctctttatgttactgagggcagaagaagggtggatatctatagtttgcctgcatttcaggatccaagtcaagaaggagaagaaagaggaatggccctattgtgggagcctccatgatcgctactgcatttggcagtgatatatactcccttaacctttcctctgcaaagaaattgataatgatacttgcactagtaaatgtccacttctaaatgtctgtataaataaaacaagtatctaaactcattcttgccccataaaatgtctacactttaaaagtaaatcatgccaatctgctcatacaggcagaaactaaagagcctttaaatttgttttgcaaacaatcacatcaggatttgttctaatatactgatgcagtggacagatttatgatttttaggaagataggcacatattttgcagagagtaaaaatggaaattcagtgatagaaaatggaggtttgctccatgtaaggataggggctcatatgactcagtggaaaatagaggataatcgactctattatcctgcctttatgtggaattgcaataatgtccattcatattaaaaataaaattgaagactttcctaataatccagtcattcacaaataaatattgattgaatgccaaatatattccaggcaccagacactctcttaagcacttggatacagcagtgagcaacaaaaaaccttgccttccttggctttgaattccaatgcatagggaacaaaagcaaatgaatcagtaaaaattattacatgttatatggtgataaattataaaggaaaaaaatcagggaatgaatatagagggtcagggaaatggcttaaaattattaaaagcgtggccaagaggtcacgttgcaaagttcacatttgcccaaatagctaaatgaagcaagggagtgaaccaccacagccagctggaggaagagcattttgagaatacagaataagtgcaaaggccctggggtggtcggggagggtggtctgtgcaagagcatgacgaagtccatcgtggctgaggagtggtcagaagaacctgaccatgtgtgcctgttggttatttaaggattttggttttaaccaaagtgagctgggtggctgctggagggtgtgaaggaagagactcctaatctgagatggatctctgggatgaatggttgttggtgtttgagaagctattgcagtaatcgagtcaagaaatggtgctggcgtggccccgggtggcagtggtgggtgaaagcactgagagtgtgttctgcgaggagacttgccaagattgacccacagaccacatgtgggatattagggagcataacagtcaggtttctggcccagcccctgcaagtatagagtgccattgtttttagattgggaatgctgagaaaggaacaggtttagggttatgtttggtttgtaaagtttaagatgccattggatactgaaataaatgtatgaatctggagttcacagaaaaggtttcgattagattataatagagcaaaatcaacttccagagtagaagtgggagttttattttttatttatttattttattttttaccagaactgctatttttacaaactgaaagtcccttagaacatacactgaaaaaaaaatcccagttattctctgagtccttacatagaattgaagaccacctgcctgtttgtctttgcctgtttccttttcttctgttcttaactcctctccagctcctgaatagcaattttgtttctctctgcctcatgcaacagacttttctggatgattcgccccatcccccgtcatgccaagcctctgccccacttcatttctctttcagtgagtggagcctccgccgtctcccagacctattgttgcctggaccctctcaagcctaccccttcctctcctccctcccctcctttactccgtccctttccatggagccacactcggggcaagaccatctgctctggccttccgaggcttccgcactgctggcagatgctccccacgtcccctagaatggtttgtgatctttctctgtctggtcccaacatgcctttccagcctcctccctccccacgccagcagttaacccacgcatccatccaggagatttcccacacagactgcacataccgcacaggtgtgacctgctggtgatgatctgctttctctaaaatggactttcccttctgtctgcacttgctgatcaacaaaaagcctgctgggcctttaagacaggcctcaaaccacctctgctgtgaagcctgcccttcctcgtcaagaccccaaacgaggctcacctccccgtgaccgtgcagcgtgctgctggtcctgccaacggtgcccctgacggagctgtggttggtcctgtgtttacctcttcggcctttccacccctccagaggtccgcctcttgtctccaggtctttgtatctaactgaccagttggacactcaccaacctgaatgccatgtggtgttctggaaagcttcctctgtaatttccagttcagatcagttgttcatcctgtgcactccagtctcatcctgtgcttaattctaccacaacaaacaacgcagtattaaaattgtctgtgcagctttctctgcagtctgaaagacctcgaagagaacagacctgccttatttactgtgcgagtatccagctagagcctggagctcagtaaatatctgtgatttcactctttctctttctccttccatcccttcccctgtcctcctctccctttcttctttctttccttctttctttcagcacacatcagtacaattccacacaatggaaagagaagagtgaacaaggcaggacatttagaagggaaagtggaggagcaaagtgaggaaatcttatcagaaaaggggtgatcagcaatgtttaatgttgtcacaggcaagaaatatgcaggcaaaaaaatcctttacattctgtaactaggatgttgcatggagatttatataaagagtgttgggctgggcacagtggctcatgcctgtaatcccagccctctgggaggctgaggcgggcggatcacctgaggtcaggagttgtagacaagcctggtcaacatggtgaaaccccatctctaccaaaaatacaaaaattagctgggcactgtggcgggcgcatgtaatcccagcttctcgggaggctgaggtgagagaatcacttgaacctgggaggcagaggtttcagtgagccgagatggcgccattgcactccagcctgggcaacaagagcaaaactccatactccatctcaaaaaaaaaaaaaaaaaaaaaaaagaatgttaacacttcttgctcctaccgtcttactcatttcttccttcgtcactcattcattcagtaaacattggatttctatttcctgcctcctctaagattttctaggcacttggacctcaaagatgaagctattctcacacgcacagattgtcaggactttgaggctttatgggtgatgggcctttacacattgtactgtctccataaagcccctccttagcttccatttttttttcttttgagacagagttccactcttgttgcccaggctggagtgcaatgaatggcacagtctcggctcactgcaacctttgcctcctgggttcaagcgattctcccgcctcagcctcctgagtagctgggattacaggcacacaccaatacgcccagctaatttttgtatttttgtagacatggggtttcaccatgttggccaggctggtctcagactcctgacctcaggtaatccgcccgcctcagcctcccaaagtgctgggattacaggcatgagccactgtgcccagccaagcccctttttagtttctgtggggacccctcattcagccacagacttgccccttcaatggccacttcattcttccatgtgcgtttttccttgttctcaagttgtctcctcagcttgagtgtgaaaaacatttcatgctttttagtatcatccttaggataagtctcatatctgtgcactttcatattgatcaaaaaaatcacaagaggataactgaatggacaactataaaacctcctgtttctctatttcatgtcagacaaccctagctcccttagctttgcttccagctcctttttcctgatgctttaatcattgctgttcctctcttaatgtgcatcatgcacactatagttctctaaaatcaggccactttaagccatccacaggattttatggaatactaatcagtgtcatgttccactcaacatgtgatcggattttgagagcagtgaacagggtgtcctctgagggcctggggtaatacccccattctgaatcacaaaggccagccccatggggtcagagggttggcctggttagccttgtggagcctgtgttctccaaacagacatttaattactgtccccaatgagtaccctgatcacaatacttattgctccaatggggtctgtgggtggggattgcaaaggggaaggttgccctgcttagctcaaggggagcatctcctgagaaagctgattccgacagaagtgcagtcaactcagcaagcctcttccttctgtcctgttcctaaaaccatctgctcattgcaggaagcgactccattccgtcagccatactgatggcattaggttctcctaaaacatctgggttttccttgtgggagaaaatcctgcagtgaatttagatgttggtggacctctaagcaagggcctcattgagtataggaggggaaattataaatgtcaaattataagtgtgcaaattatacaagtgcacccctgcttggccttgcagggcaccactggccagctcccccctctccaatttttcttctgttgccgtgatggtgaatgttagttgtcaacttgattggattgaaggatgcctagatagctggtaatgtgtgatttctgggtgtgtcggtgagggtgctgccagaggagactgacgtttgagtcagtggactgggagaggaagacccatcctcagtgtgggtgggcaccatcccatcggctgccagtgcaggcagaacaaagcaggcagaagaaggtaagataagcttactcgctggttcttctggcttcttgctttatcctgtgctggatgcttctttcagcttctcctgcccttggacatcagactcccggttcctccgcctttggactctggcacttatgctagtggtttgccgggggctctccagcctctggccacagtctgaaggctgcattgtcggcttccctggttttgaggcttttggacttggactgagccactaccggcttctctcttccccagcttgcagatggcctatggtgggacttcacgtcgtgagcatgtgagacaattctccctaataagctccgtttcatatacacatacatcccacagatctgtccctctggagattcctgaccaatacggttgcccacccttctttgtctcttctttgccacgttcacttctacgtggcctcacggaacccacgtggccttgcctttctggaatcgcagtctcctccatgtggagatgcgtcacctgtagctgatggataatcacttggaaatgcagctgccccggacgggaaggggttgtgcatttctcatattgtttttggctagaccttgagaaattttgcttcctggacaacttagtcatattttatgaagatcctttgtcagtggctagaaaattggacatgtatgatatatggctggggaggactaatgggctcttccttcaacactctgtcaaagtggggccagtgcccatggtggaacgtgctttagtaagatgagagaaggtgttttcatgattaacaaggcatggcattcgtatttcaaagatcacatgacatatcaaaacagtctgctaccgtgtatttatttggtggcatggacatgggacatgtggtattttctcagggacccttcggccctggacctgtgctgtgcaggcatctgcctgtacacactgcagctgttaacctgtgcataacaaacagccaatgtaagatcagatttgaggctgggagtggtggcacacctctgtgtgtgtgcttacataacatacactcaatgtaagatcagatttgaggctgggagtggtggcacacctctatgtgtgtgcttacgtaacaaacactcagtgtaagatcaggtttgaggctgggagtcgtggcatacctctgtgtgtgtgcctacataacaaacactcagtgtaagattaggtttgaggctgggagtggtggcacacctctgtgtgtgtgcttacataacaaacactcagtgtaagatcaggtttgaggctgggagtggtggcacacgcctgcggtcccagctactccagaggctgaggtgggaggacgcttaagctcaggaggtcaaggctgcactgagccatgatttcaccactgcactccagcctgggtgatagagtgagactctgtctaaaaaacaaaaccaaaaaaacataagatcgaatttgactcgaccgtttgtccctctgacacgtaatctaagatgtcagaagtatttgtgtcaaagaaggcaagtgggagagaccgggcctgaggtgatgctgtgttccttctttgatgacatcattaacgaggagagggatggccaaaagaatccaaaatgaaaagtgtgctgataacagaaccaatcacaggcacaactagcctgggattccaggcctgccgaggctgctcactgcggagcctgtgtctgattctgtgtgaccagagccttggctgcaaataacgaccagcctttcctcatcacccaccagcaggcacccaccacagccctgtttgaggtcctttgaactcacagttttagaaaaggtcagtagtcaggtgatatggtttagctgtgtgcccacccaaatctcatctgaattgtagctcccataattcccaagtgtcctgggagggacacagtgggaggtaatcgattcatgagggtgggtctttcctgtgctgttctcatgagaatgaatagggcttacaagagctgatggtttataaaggggagttcccctgcacttgctgtctttgtctgctgccgtggaagacgtgcctttacttctcctttgccttctgccgtgattgtgaggcctccccagccatgtggaactgtgagtccattaaacctctttcctttataaattacccagtcttgggtatgtctttattagcagcatgagaacagactgatgcatcaggataagtccacattgcaggctcttcagggcatggccccgactcgctttcccatctcacttttggcctgtccctcatgtgtaccctgggcccagctgtgacctatggaacggtataactcccctgaatacactgtgctcccacagattatgtgcctgcccactccatctccacagcccccatggagaggagagaaaggggtggcagactctgcctatgcgcccttgtttcttactcagagataaaagttcattcagaaaacatcttgagttcccccaggctccgttacttccttctttgctcccatagcattacctggtgaaaagtgcttctgttgcaaaacttatgttcatgtgtctgcctcacttctccatgaggggctcagtttcttaagaggaggaacagaaaggctaggtctggtctctgcatctccaaccgctaggccaggcgttatatccttggtgcgtgtttatagaatgtgatggtagacatggagtgtggtggggtgagcagagcagatgtgattgacattctggtgaaaaggctgagcaaacacaggacccactgctctgtccctgcactgggctgcgtgctggagattcagtggccactcatgctgctgctgtgttcttgtggaggtaagaggcagtgggtagaggagcaacaggtgatatgtgaatgctcctgactttgtaggaaatgggaaaggggctgatgggtgggggtgcacgtgggtgaaggaggtctgggaaggtgtctctcctgagaaggcagcagctggtctgggaatgaagggtgcgatggagctcactgacaacccaggcacaggtgagagcaggtgcacagtccctggagagaaaagaggctgaaaggctggaggaaaagttgagacccatgtggggagggacggatgaaggttcagatcaggggcctccggaagtgagggaaggagcaacgcactgacgctgagtgctttcaagcaggggagtgcagagaatggatttcaccttgaaaagtgaatgtggaccataacaagtgttggcgaggatatggagagaagggaaccctcacacagtgttagagggaatgtgagttttacagccatatggaaaatagtgtggaggttccttaaaaaaaaaatccaaaatagaattactggatgatccagcaatcccacttctgggtttagaaccaaaggaactgaaatcagcttgtcaaagagacatctgcactcccatgctcactgcagcactgttctggatggccaggatatggaaacattccctgtgctcatccacagatgaatggataagaaacgtgtggtgtatgtacacaatggaatactatgcagccttaaaaaagcaggagagtctgtcaattgtgacaacatgaatgaacctggaggacattgtgttaaatgaaataagccaggcacagaaagacaaataccacattatgtcacttgtgtagaatcttaaaaagtcaaaattacagaggcagagactagctcagggatggttgggggtgggttggggagatgttggtacaaggatataaaatttcattggacaggaggcataagtttttgagatcaattgcacaacatggtgactatatttaataatgtaaagtatgtttcagaaattgctgagagtagattttaaatatttgtaccacacacccacaaacataagtctgtgaggtgatatatatgttaactagcttgatataagcattccatatgtgtatatgtatatcaaaacatcataatggaccccatgaatatatgtaattattatttgtcagttttaaacattttttttaaatgaacatggaggttggggaaccttaccagggttcttttggtctccgccttgcctggggcccagaagtgctggtgaggggttgctccctactctggagctctggatgctgatcagagaccctccatgcctggtgacatctcagactcagtgaacagcctcaggggcccttcacaaaactgggctgtcagggccacctggagctcagagtggtaatttggttccatttgaacttcaattttcgttgctttgaaatctcattcagttgaatttaataacaaataaataattcatggggactggacaatgaaaggaaaatttaaaaatgtgttcacccaaatatataaaggggcaccttgtccctcagccctgttctctaccttcttttctcagctggcttctgggcagattcatggcgccaaaggatgatgcgttaactctctcagggtgctgagggttctctcatcatgagacttctgtgggttagggactgggcaagaggtgagcaagtatcccacctctggcaggccagcctctcagccaccaatttgctaagtggcccaccggtcatctctgagccttgtttccttgcttgtaaaatgcagaaatctttagtaaaccaattgatgtaggcaaatgtcatgaatggatacacagtcatctcagggaatttacatggtgttaaagtatcactccagggatcatctgctggttgcaaggggagaaatgtgactttatcctggagaacaccgatgctctccaccttatcaattcctgcatccctaacactgggacaagcagatatccttccatgccccatgcggtgcctagcatcacctgtgaggtaatgccacaaacttgtgagctgaacttaatcaagctcttaggtctaactttcagtgcgtaacaaacacaggctgcagagcatccagctaatgcacaccaggaggaaacagccagacaaatccagaaggtggaaacgtggaggcaacaactcacccattccttccagcaagccagcaatgtgtggtgggctggggagccactggggcggacaggttctaagttgaaatatacgttaccaccaaccaagggcaattcctgggcctcggctaaatccttacctatacaaaccagctataccagtcactttagagtaattggggaagttattacatgagattagaaaattgtattcattttttaagtgtgaaaatgttctttttcctttttaaaaaagcttctgttttaggttcagtggcacatatgcaggtttgttacatagagaagcttatgtcatgggggtttgttgaacagactcttcttaattatacaggaaaacgtctagagcttgtggtctctcttctttagcgttgcttactgagattttttaaaaagatgcatcctgaatgatttcgaggcataatgttttggtacctgtatgcaattgaaataatttttaaaatagatatggagtaaatatgaaaactaacaattttcaaaattttaatgaggagcatatgaaaattatactctagtatgctgttacttttcttttctttttttcttttttcttttttcttttttgagacagtcttgctctgttgcccaggctggactgctgtggcacaatctcagttcattgcaacctctgcctcccaggttcaagtgattttcctgtctcagcctcctgagtagctgggattatggggcacccaccaccatgcccagctaatttttgtatttttagtagagatagggtttcaccatgttggccaggctggtctggaactcctgacctcaagtgatccacccgcctcagcctcccaaaatgctgggattacaggcgtgagccaccgcgcctggccgctgttaattttctaatctttaaaaataataatagtttttttaaaaagctgctcacaaatattttattgatgatgtgtgcatttttttttcctctggtaggacataattctccctgagaaggggaaagacagtaagaattttgtgagttgcataatagtccattgattaccctttgtcccccagtggagggcactaaacccctgaagaagcaggcccctgtgtgggcgtgttatgattgtagaacaaggagaggggaccctccagtactcagtgtctttagtgggtggggcgggggcttcaaggcagtagcctcagatacctgcggggcccatgcagggaaccctaattggggtgcagggtgggggagcaacagaatgcaaaatagctcttagtaccttacctaaatattggttgctagattttttcattgactggaagctttcatttggctctggatagaagtgtgggcagtcacacaagtcaaggtaagaggggtggaaactggtttttgctggtgcttcctaacatttgtcaactgtggctttcaggctaccaatgggtggggagttttgtgcgagaaaatggaccacatttgcatcctggtgttctccaaatgatgttaaatgcagaaacattcaatgcaatgagtttgttcaattccatccaactaaaaattgtgtttgtgctattagtgcctaccctctgatcagtcttgtactaggtaggaaacatggtgcttaccctttactaaggagttgtgttacatgaaacagaaaacactatgactgaatcaaaaagaagcatcactctgcttgggtagtcagggaagaatcttgatttcccctggaatctggtacttacctcgcggtgaatatacaataacagccagagttttaaaatagacaagaaggacagaaatcagagagaaaaacacagacacatcagaccccttatcataaggtacaaacaatagagcagaagggagaccacaaacttccattctttatgggatgagcgagaaaggggatggaggctttggcaatgttgaatgggttttccacaggaacagccagccccaactgatgtgtagtgatttcctaggaagtttgcaaacctcatcccaccaagaggaaatgggtcgggagttctccatcatctggaggtcacagagcagacagaccatggcccaggacaagatctagaagttgttattttattcaaagtcagaaaaccttccagggtctggggatcagtgtctggatagaagagaaaatacaagagaaagcaagaggttaatgtgggctgaaggcttagaatgagcagttttaggataaaggatagttaggaaaggatgggggatggagaggagggtgcatgtaaggcaggacaaaccaaagagaaagacctgaatgtatctgctgtgtctgtgggacatagggaggttctgttcattctgaatgggggcttcgagctcaagcctaaaaatccatcctttcaaataggtacagaaagaagggctttgacaagtaccatgggctgtgcttgattgaaaggacagacacattcagttgttgttatttgtgattattgtcagctccatcattgatggcactgtgcattttttgaagtaggtctctcccatcaaactgccaggattccagtgatcagagagcaggtcttcagtagcacaggctggattgggtggtgcccactcccggcttgaccacttagctctgtggtgccttggtatcctcatctgtaacgtggggataataatggtgtctgtctcataagaatgttttgagaaacaaatgagaaaacccaagtcaagctcttctagaagtgcatggcagatagtaaacagtcaatcaacattatcagtcctatcaccggtgtgggtactgttgagatacctgtgagagtaaatcatgatttatgccaatggttaatggaaaatatttattttagttattttcttatctgggtagtgccagatgggataataaaaatgaaaacaggcagggtttcgtgtgtgtgtgtgtgtgtgtgtgtgtgtgtgtgtgtgttgctttgtttgcaagcatgatttagttgaaattagatgtctcttctgatctataatctctttgtcttcagactgaaacctgaaatcccatctgaatatggctgaagcaaatctgcacacagtgtcttgatgggaggatatgactaactcttagattggaattgtgttggtgcgtaggcaggttctattattaggggtaatgttaccacattattaaaatatttttaggcataagacaggattctttccttcacagataaatggtgaaacacacatattcctaatttttaaattttgatcaaaattttattaaggccaaaatgggcagagactgggtaacagaagccatattttccaatttgccctcctttactctcccagattctccttgcatgttggctggagtggatcacgaagggtaggaagctgagaaaggtggaataattggaatgttctgcaactctgaagccaaacaaacttaggttttggatgacgtggacagtggatatcatatcacctgttatggtgaaaccatcaccaatacttactttacaattcccatcacacaccccagtgactttctgtgaaagagagatcagatatctactgtatttagatcaactattacattatcaacagtggaggaataaggaaatctaggatgctgtttagtagcaaggaatgcatcaacaatagataaaaggtggccaggcatggtggctcacacctttaatcccagtattttgggaggctgaggcgggtggatcatttgaggccagaagttcgagaccagcctggccaacatggtgaaaccctgtctctactaaaaatacaaatattagccaggcgtggtggcacatgcctgtaaccccagctcctcaggaggctgagggaggagacttgcttgaatccaggaggcagaggttgcagtgaactgagattatgctgctgcactcctgcttgggcaacagagtgagactccatctcaaaaaaagaaaaaaaaaaggaatctctcagtaggtactaaataaaacagggaaaaaaacataactaaacataactacaaactttcttttctttcttttttttgtgataagaacacttaacatgagatctaccctctccataaatgtttaagtcttgttaactgaaagcacaataggatacagcaaatatctagaacttatttcattttgcacaactgaaactttgtacccatggaacgcctcccatttccccttctcccaagcccctggcaagcacctctctactctctgtacaagtctgcctgctttaggaagtggaaccatgtagggtttatccttctgtggttggttcatttcacttaccataacatcctgtaggttcagtcatgtttttgcatatggcaggattttctgctgtattaaggctaaataatacttgatggtatatatgtgccacattttctttatccattcgtctgtcaatgagcatttagatggtttccacatttgggctattatgaataatgctgcaatgaacatggaagtgcagatagttctttgaggtcctgattttaattattttggatacgtacctggaaatgagattgttggattatatggtggttctatttttagtgttttcaggaagcctcatactgtattccaaagtggctataccattttgcattccccccaacaatgtacaaggattctgatttctacacatccttgtcaacatttgttttcctacatatatatatatatatatacacacacacacacacacatacacacaacacacacacctacatacatatagatatataatagcaaccctcataggtgtgaggtgatacctctttgtggttttgatttcatttccctgatggttaatgatgttgaacatctttttatgtgcctgttggccatttgcatgttttagttgaagaaatgccttttcaagatttttgcttttgtttcttgtgcttttggtgtcatatccaagaagtcattgcctgggccaatgtcatgaagcatttcccccatgccttcttttgggagttttacaatgtcaggtattatgtttaagtctttaatacattttgagtcgttttttatgtacagcataagataagagttcagttctcttgtatggatatccagttttcccagcaccatttttggaagagactgttattttcccatcatgtattattggcactaactataatggtgaaaagttaaacgcttttcctttaagatcaggaacaagacaaggacgcccacagtcactgcttctattcagcatagtagtggaagtccttgccagggcaattaggcaagagaaagaaactaaaggcatctaaatgagaaaaagataaaattatttctatttgcggatgacatgatcttatgtgtagacaacccaaactttcttatcttcacagaatattttgcaagagttgagctcctagaaaatgagcttagatcatttctcccctctggccagtaacaagatgctcctacactgagcttcatttagcacagccctggacacaccaccaggcactcagcaaacatcagacaatttccagttcaatggaaaattctcagttatccatggcagaatcatggccctgtcatgcactggctgagtttgcttgaggaagctgcttaagctttctgactcttggttttgttatctgcaaaaggggaatagcagtgtctataccacagggataatatgaaggctaaatgagatcctgtaaagcaatctttccaagtcctgagcttgacacaataataaaaactaacctttatttaattattgagggtggaggaaggaggataaagaacagaaccaaagaacagaagttatttcccagtgaacttaaacaattcatgagttttctcatcttaagcagggaggccttaactgcattgtctcatgcctttaaccagtgagagtcagagagagctaaggcacatccaactccgttgctcaactcccaggcacccagcaacaggtatagagcattgggagctgcactctccatactgatgttataattaatcttccacctcagtcaaccgatcatagagttccacttttggaagtgttccaacctgcacccaggaggcttctgcagtcttttttgctgccagaatgtcctccctgatttacacctgacttcggcaacatctgagcattcatatctgtgctacatgctggctgtagccatgggtctcattctaaaacatccttgccttcaaatacaggcatgaggcaggagtggaggaaggagaggtaagaaactattcatcggccgcctcatgggcatgctgacggcaagagttatgaggtgtaaacctgggttcacatcttgttttcttctccaggtgagggtacttcatagagctcagaagaaactcaaggaccagctctctcgggctgcccctgtaatatggcccactgagggcaggttcctggctgcccttggaacagtgctgcagtcatcaggtggtgtgaaagacaaatgcctttgtgccctcaaaggcaaccagtatatatgggaggtgctgtccccccttctgccactcatcagctcatggtaaacagaggccacttaggcaccactcaaggcattgaccagtctgagtcctaattatagggtcctacttatagccattatgaacctcaaagccaaacaagatgaattttgtcaaaggactcctcctggctttagttgaacagaatcatcagactaggaagccattagtgaccttcgtgagtttccagatcttcattctcatggctcttatcagagatttgctctgaggtgatagtgttatagggccctgatgcaaaaagcccagtgcagattggcttacctgctgctgcatcttgattgtccatgggtggggtctactcctgaggtcttgggattgaaaaagttcacacggactgtaaatcctgccattgctactgatgacacttgtacttgttgcggtgtgtccattgtagtgggaagagctctgctcttagagtgttatacagcctatagggtttggattcttcacatttggttggttgactttgagtctcagcactttcaattgtaaggtggggacagtacaaacttacagaagttattgtgaatacacaaccatccaagtaattacacctgcagagctgactagtttactttcttgcttgctgtctggtaaaactcttgccaatcatagacaaacgatcaatgcataaggtaacctcatttgagagttcaagttctgaacagaagaaaaggatctcattcctgttatgaacagcttagttataaagtcaaatgtaaaatcaaatatgtgtttctgtggcaaatggttaaattcttaccttttacaaaacattcagtagtcacaaggtctttacacacccactgcttatccatcatatttatatatggtgtgcctgttaggtaagacatacacactttggttagttacttgaatagatcataaaattaagtctaggactatgttttctgctttatttaaattttctcatccaaggaaaaatttcataaagagtggttaaatgaatgaatgaatggacatttactgtcttgaataaaacctttttatataacttagcttgttttgcaaaagaataaaacactgggttcaaactctttatttttcattgatctttagaaatcagggtccctcttttgaatacaccccttgctcaaggaaaggaaccatttatgttctggccttgattactgcacaatggcttttactacatttgatttgcagcagttcatttgtgattaaattttctaattctcccagaaagtcattgaacaagcaaacagtttactttccccaataaaacaaaacctaaagtatttggtctttaataaatgttcaaaaattattttctcagtgtgtgttcgagatataaatatcccttcatctcaaccgtcttttaaatatttgaccaatctacctttacagagtagttgtttctccttatgtcatttctgatctatctttcttgaatttttctttgcttagtttttaatcaagccaaatgtttgtttaatcagatacctcaattagtcaagacctgtctcttttatcagaaggtgaatttagagaacaattctaaaacatagggtaatacaatttttttaaaagaaaaataaccaaattctaagctcagcttggtcccagggcaaattcactcctcattcttaattcttcttctccatttctggtcacgggaggggcacccccaaaatgctgaccctaggactccccaagatcctccagcatccaaaaggcctctcttctccagtctttactttctatgggaacaggttgaaacccctgggaatgaatacattctcaactaaaaatacaaattaaaagaatttcttgcttagactatcagaaacttgatctagtgcacatatttcccaagcatttcatttactagatctgattaagacactctgttattgtatcatttaaatttttaaattttattatttaaattttaaatacaagttttaaaggatggttacaaattagtaactcaaaataattgagtggagagatcaaggtacaagacactctgcctttaccttcaaagtctgagcaaatatgattttatatcgttttaatcagagattcttttaaagaccaagttactgcagtcctgtcttgttcttctcctattttatactgatgtgctcagtaccttggtgtctttgtctgtcttttagggggaagggaacccacgttttggactagagtagcacagatgccattcttacctcactgtaggtttctttaaagaatgtttagtcctgacaatgcgatgcagatttctttctctccccactctatcttctcttgcagagctttatccctttttcattgttcagcatgactgggaacctgccagctcgccacaatgaaacataatgtttttgcaaagtgtgtgtcaaatgtcgtgagcttagaagagattcatcgtagagactgctgcttaatgagtgtaaattaactgatcatttgctaaatctgatgtgcccagtggtgtgggtgggagaatgctggataggatgtaggagatgcaggtgagcagacgggtagcagagacacataccgtgtttctgagcgaggactgtagcatggccagaaggctgttctgatgtagagagggattttccgctcacggtaggacccagtaccatgagactgaggactgaaacacaaagttaacacagatctcccgaacagtctgctttagggctggagcctgctgggatcagtcctcttgagaagaactacaatctggttgagattgaacttgccaaagacaatgagactaaacaagagatgcctgctggtaaacatcaggggtgttgtgtggaagctgagggaggaagaaaacacaaaagctgtgcatgatgataaggctagtgggcctagtgttaccagtaccacagatctacagctcctcctagaggcagggcacattcagaataagcaacagggagctgcatgtcatgtagtcaagcaactgtatatttcttcttcattgatttctgggacatacatatgaaatatcttcagcttcatatctgagatggcaggaacatgacaacatattagcttttaggtagacacccgtaggtcttaggatgtggtggaaaattgggtgtcattttttccagataatcactggcatttttataaaacatgaagcccttcctaaagtctgtgcttcccagatagtagtgaggagaaataggcttgtggagaccataagggtttattttggagtgggtcttgtgaatttgacagtttaatagtcacgtggacgcacactgttgtttgcaggaggggccatgaacccctgccctgaatgaaagggaaatacttatgtccgtggtaaccagggccagtggcagccaggaagccaagacctggcctccgctgccactgctcatacaaaccaaacgtgtacatcacgtatgggatataggagaagcacatctgaagggctatggcagaagtggaaagaaggcaaaactcttccacacaggcaacccgtgctttccagacaaatctcacaacatcaaactagaagtattcatgccaccccctacccctgccaactagaactggctgtctgtgtcaggtcgtcatcttatcttagaacacatccattgatacatacactgtttcttcttccctattacctctgattctgcttctctaaaataaaagctgaccgactggttggaataataatacatataccacctggcattttacagttttacatcatctcaggtgatacaaccaggctatgatgcagtcatgtcaccatactctttaccagatgagatgcaaactcagaaatattaggaaatgtagctgtgatggattgggctataatcaacttgtgatgtgggagtttctcagaatctctttccctatatacatatggttccgagctagagctggccacagtgaagccatgagacttgggaggtgaatgaaggaggggccattatgctctggaggttttcatcgtgtaactgaacacaggtccggatgctcaccgcctgcagaatccagttaacaagaatgagttctggtagaaagaaagtgactttattcactcaaactagtaaagaacaagtggccgggttcccatccaaagcaaccacttcaatttggcagagaggaagacaggggtttaaaaaaggaaatcttgacgtgaaaagcttgcaagaattgtgctgagtacaacgtctgtgtaccttgttctggtggctatcttgggtcccagtttacctggatctcgggctggtgtcatctcaacaatggtgaggctgttgactcgccaccttgaagtcatctctggaactttgcaggtgggtctccagacttggttcatgtgtctcaagattacccccaggagcttctaaaaagggacataattagatgctagcatacaggtagatgaatgtgaagggagtatagatggtgagaaagggagggatgtggagttcattttaagacaaagagggaaaggcttctgcaatttgcttcaaggttatatcttgaaacgcacgagaaataagtaaaaagtttaaaatgcattttgcagttaaactgcccagttacaattggtcagaagtggtgagagacacagtggagctgacacagggtgcaagtttgtcttcactcttccttacccctgtctttatttcccgatttccagccctgctgacttgcagtgagtccagggccaccatgcgatgctgtaccccactcgacagacctttacttccatagcacctcacatcattcctgtaaaaggttgttactctataatattccaaatattgagagtttcactctcaagtttgaactctgactgacacattacctgtggtctccaggtgggaggtgatgtgttttttacactttataatttttttttatttttatcactcactatacttgactgtgttatgatttctatattcgtcattcttcctgcatcattttctctcttctttttttttttttctgagacagagtctcgctctgtagcccaggctggagtgcagtggtgtgatctcagctcactgcaagctccccctcatgggttcacgccattctcctgcctcagcctcctgagtagctgggaatacaggtgtccgccaccatgcccagctaattttttttatttttagtagagacggggtttcaccatgttagccaggatggtcttgatctcttgacctcgtgatccgcccgcctcagcctcccaaagtgctgggataacaggcttgagccaccgcgcccagccatctatgttcatttcaaaggggtcttccttaatgatagtgcccttgaaccaaaaattaaagagttgattaaagtagtagaaaatggtcatctatacaagtttcatgatttataagaactatggaaattgctccttagaaaatagctttctaaacatgaaaatacagttgattagaaacagtacacatgaggaactctggtttcatgcaaagttgaaggaaattcttgtgaaattaaaaatgcacccagaacagttgatgaagtctagtccaatgaaagggttttcaactgtttgatttccatcttgtcaaagaatcaacttttggttttggtgaatgaagtggtttggctgtttccccacccagatctcactttgaattgtaataatccccacaggtcaagggcgggaccaggtggagacaattgaatcctggggctggtttcccccatgctgttcttgtggcaatgagttctcaggagatctgatggttttctaaggggctttcccctttgctcgactctcatgccctctcttgctgctctgtgaaggggcgccttcctccataactgtaagtttcctgagtccctcccagccatgtggaactgtgagtctgttaaacccgttttctttataaattaaccagtctcaggtatttcttcatagcagcatgagaacggactaatccggtaatattctccactgtttttctattctctacgttatttacttctgctctattatttattgtttccttccctctgcttgctttgggtttagcttgctcttcttttgctagtttcgtaaggcagagtgtaggttgtggattcgagatctttcttccttcttaatataaatgtttacggctataattttccttccaattactgtttttattgcattccctaagttctggtatgttgtgtggtatttttgtttttattcagctcaaagtatttttgtgtttcccttgtggtttcctccttaatactttggtaatttatcagggtgtttaatttccaaatattcttgtgtattttccagttttccatctgttactgatttctaaattcattctgttgtgatcagaaaaagacactttgtgtgagttgatttcaaccttttaaaaattatgaagacttgttttgtgacctcacatacagtccattttagagaatgtttcaggtgcactggggggacatgtgtattctgctgggcttggcagagtctaataatccctaatatacctcgcttctaatgtaggtgttcccaccagagcatgccagtgtcatgtccacaataacaaacaaaaattcttttttttctttttctaaagccatattgtagattcccagttcaactataatatatattattttagctatctatttaaagtgtcacatcatcctagggacctttcaacggactgactacatttctcacaattatagtaattactgaaaataaacacatgagactattctcttcaactaaaatatcatcttattttacatttagtacaattgagaaatttgcatgtaaagctaaggaaggacacagctttagaaacaatggactcatttctctccagacctatgtgaaagttggtttgacagtaattaccttatgggagcccaaagttatgaaataaggatgaggaatgattgttcccatcacagacggatcaccacatcatcccctgtgcatttgcatgttgtgtactgatcagaggtggcgtggtgtggaggggcggcagtggtgacgtggaaatgtaaagaatttcgtgtactgaggatccagttaaaaatcacactggaaagagaaccacatatagtcaaggaaagaagaagtggcctacaaacctgtgatatgatcttgaaatgacttattttaacaagcatacctcccatctattatataaaataaaccgaagttactagaaagagatgggggttaaattccctatcacttactagctgagtgactttgagcctgtttcctagtctctgtgagcttgtgtttcttcatgtgggtaatagaagtcataataatactcactttagcaatttgctgtaataattggcaacaatatcttgaagcacagattataatgtccagtatgtaatagccctcttgtatgtcgctgtattctttctactgtccatagttctttaggttattagactgacttatgaactttgagcgctggtcatcagacctacttcacatggagcctcgagacccctccctcgaattatcagacccttccccctctggccatcatcctcctccctctgatcatcactgtgcgccctttgaccatcaccctcttccctctggcatcagactctcctccctctgcccatcctcctcctccctctgaccatcaggcccgccttacttcctcataccagcagccgtggagtggatcttcaacaagcagccaacagcagccagggacagatcctcgggcactgtttttctgtccgaaaaatcagaatcgtatcaaagggtcggacacctggactggcaagacacattggggttatttataacaggggaaaatgaggtctccagggaaacaaaccataataaagaatatgaactcccgcagaccgaattgccttcaacgatcctcaaagacttttgtgtttgaccaatatcaattaattacatcagtaaataactgcctgagccttgtacttctgtcctcccaagatccagaatgacttctgctttcaaaatgaatttcagggctttctttgaagcagtcttgtaaagttgttatatttagtttaaattcaattaaagctcaatctgaaagctctttctgaagcatttgttccacatttacatgaaggtatttgctcttaaaattgttaggggtatagctcatttctagtaataataagtggtatttcataaaccaggatacatgatcatttacttcctgatagcttgcttctcccagatctaattctattcttccttgagggctgttggtgccagtgccagggctgcaaacatcagggttagactggagagtgacccgtgtgctccttcacccctgggtggggcctctgtgcttatcagtaggctagcaccaggtgcaggagacagatgtgccgcctgctcacagggcttacctgggacaaatgtgccgctcgctcacggggcttacctggggacagttgtgctgcccgctcgtggggcttacctggggacactcactatgattacctgggacaaatgtgccgctcgctcacggggcttacctggggacagttgtgctgcccgctcgtggggcttacctggggacactcactatgattacctgggacagatgtgccacccgctcactatgattacatgggacagacatgctgcccatgccggggcttacctgggacagacgtgccacccactcactatgattacctgggacagacatgctgcccactcactatgattccatggggacagacatgccgcccacgcacggggcttacctgggatagatgtgccacccactcactatgattacctggggacagatgtgctgtctgctcacagggcttacctgggaatgaagttccactcctccacttgcttagttcttgtttatttgtctctcccaccatttcaagtctttgctatcatcatgaagaaatatgcagggtgctggctgtgcagtgatgagctgggagaaaatgatctgtgacagagctggtagttaaggaagaatcccttggctgaagcagagtgtaagggatgagaagccaaatgggtggagagcgggagcaggggaggagggtgagagcatgagagggacactgcatctccagaggctggagaggggcaggggtgcagcttgtcatgggacatgtaagagggccagggactgatgcagagagggacaggaagcagcctgcaccggcactgtgggagcaggcagatgggaacgtggacagggagttagtgttttctcctaaatgccatggaagacattgatgtattttcaacagtgcagatagaaagcagtaaatggtttcaaaaatatcccaaacaatacaatatatagaatttcctgatggatttgacttgcaaacagagtggaagaaagaagtatgatggcatctatgctttgtgctttttgagcaattggttgaatatggacaccattttctgtcactgagaagactcagggaagggcgggaggatgggggtaagtgtgcagggccggtgaaactgggagatccgtgagatgcccaagtggcaacgtcagctctgaggaaatgacactcagagacatggcctggactcgaaataaaatgtgggagtagttagcacacagattatgttccgaacctggaaatgaatgaccacacctaggaagaaaaagcaggaaaagagaggagagggcccttagagatcccaacagagggggctgaggtgtgtgtgtgtggtgagttggaggacagccagaagaaaagatgacgttccaacagctgagatgcagtcagggcgcagcccattggtatgcagcgtggaggtctttggagacatcactaggaaccgtttactaaaatgtcactaggagcagtgcctgtagaaaccagatcagggcacacgaaagggtaaatgggagacgagggagacatgacactctgctgtgtggactcagaaacctttctgcaaagagaagccaggaacacagcaggatgcaaactaagacgtgaaaactcattcttcgaagtcctttcagagtcctacctgcttctgtttatataccgcctacatttctgaaaattctagtgtaaaacaaacatgtatatattaaattacgttccttttacttttgttaaataaaaagtagtcgcattagagaagagcaaagctaagaaacataatgaaatgatgtgtaaggatcctaacatgaccactaaagagcaatgcacctgagtgtgaacgcatcaaacgcttccaggcctggcagtcaatccatgtgccatggcctcttacaaggaagtcatcgttctaacaccccatcggtagggcacaggctttggttattttatcagtgcacaaaaatgaattcacactgttactggctttcttctgctggtgcacattaggtgtgatggctccttgggcttacggatgacccctgtggctagaggcgagggtgaagataatgggttcacattgcacagattaaagcagagactctattgtgttcagaagaacctagagttaatgggccacaaacagatcatcttctggcctccctagcagagccctcggttgcctcctgacacagtccatttccactttgacacaagtgtttgccagctttgtggtacctgattattagggtcctcttagttctgtgattgctccaggaattcggtaaaaattgtcatctggaagaaccaaattgcagttcttaactgggtagaattcaggctcttcaattcttgattccattcattacgtgctcactgtaagaagtggtacctccttgggatattgaatcagaaaggtattagagaaagggctattcatggtgtagggatctttggacttgaaggtgaaatttcaaacatcttcaatattcattttggttctgggagaggtaggaaaactgtctagaaatggtccatttataatcatatatgtgaatagaacttagcattttggttggttggttggttaaatgtgtgattgtgaaatagggctatgatgagttgacataaggggaaatcgacctttaagtagggtgaccatataattttttatccaaatggggtcatgagagagggaagagtggtgctattaacattcacattgagacagatgaaaacattcacgtccagacagggaaacctggatgtgctgtcatcttatgagggcttgtcatttgctaggaacaatttggtggtcgtttttccttacacaacaaggagagaccaggagcctgccctcttggtagatcagctaaacatgtccacaggattttgcttccaagatgaacatgggtgtagctttcaggagtgtccatcgagcatcacgattcgaaacctgaattttcaggggcttctctgtcttgtcaccttcctttgctgcatgcttcagtctctgcttgaatttgcacctggaaatggggttgaaatacatttggtgcagaacgatagcatttcaaacctgtctaaacagtttgcagacattaaaaaggatttgtatgccaagaaggaggcccctagctcatggggccagccccagtttgccttccgaatatactcattttgctgccgttaaagactttctgtgtaatttgagtcaaaatatccctattttctagttataccgattttcttcacttctaaaccccaagccaccataacacttttttcaaagtctgttttgctcttcccaccccttccagctccttgggggatttcaagatgggattgtggagcatagttaaatccatcgtaattacattcagtcagctgtatcccctcttcttctttgcctttgggatttcactactttaaaaaagtattctctgttgctgaacaattaaacataacgctaaccttgcagtcagattagccataatgaatatggtgtgggcatttgatactaagttacgtcattttaagcaattaaattaatatctcaaagtcaaaaagctaattccaatgattgctgtagacattttaagaaaatattttccaagagaaaagggatatcaaaatataaccatttttcttttgccaagaatacattgcatttgttttaggtacagataagaggcattttaggtatagattaaaatctgtggtgaggaaatgtagtcaagaaaagggctttacttgcactggagaagacttcccctcatgcacggccctcactaacttggagctgagctgcttgctgtacacgagctgtgcatccaagtgagcctctgtagtccagcccaggactgctatctgctgttgcctccggctttctggtcatgctgggggagttggggtaaacaggagcagcatctcacacacacacacacacacacacacacacacacacagacacacacacacacacagacacacacacacacacacacacacaaaacagctctttctgaggttgggaaggaatcattctttccaatggcatcgttgcccagcgttggccagactgtgatctgtttctgtccaagaatgaagacagctttccctttctaaagctgttctcagctgttccctcatttcacaagctgctttccagctctgatgtctgtggttgctgtagcagcaggctaagccacacctgacccacagaaggacatgaggttggttctacctcacagagagaagctgaaatctttgttcctattaacacaaagataaggggctcggaagtgtgcctgagcgaatgggactgacagtagcaatgacggtggaagaaagcccaagaacgtctccacagagggatgcctggcaacacaggagcaggcccacatggccagcatctctgaggtttaccttacccgcaacaggcacagctggcctctctgccccatgcatgacttgccacatccctgaaatacgaattgcatgaattttatgctggaacaagctgcagagtgatcagtcacatttgcagccctgtggactatggctattggaccgtacaattaaaattaagtttgacattaaatctaaaacaaaattttttgaaaataaaaaggctagacatggtggctcacatctgtaatcccagcacttggggcagctgagatgggagggtcacttgagcccaggaattcgagactgggcaacatagtgagactgtctatttttctttttttgagacggagtctcgccctatcacccaggctggagtgcagtggtacgatctcagctcactgcaagctccgcctcctgggttcacgccattctcctgcctcagcctcccgagtagctgggactacaggcgcccgccaccgcgcctggctaattttttgtatttttagtagagacggggtttcaccatggtctggatctcctgacctcgtgatccacccgcctcggcctcccaaagtgctgggattacaggcgtgagacaccgtgcccagcccaagactatttttaaaaaatacatttacaaaataagatacatttaaaagtaagttgtctcatctgacggcagccttgcctgggacactgctccaaaggcaatcttagcagggactcaaatctgattgttactgctgggtcttctccctgaccctgggaggtataactacagaatcattcatgcagcatttgcaacttaccaaagggtaactttccacagttcccagcgttagcttagcaaccagagctgcagaatatgccgtcctgggcagaaaagggaatggtgagtactgtcagttgagctttgcatcttctctaccttgttgaggacataacatctccatcagagattcttacaaacccaccaccccccgacacacccccaagaagaaaagcctgggaagttctttctacccacatgccatctttagaagttctccaactttatggtagaggtcatcccgtcctggaaatgtcagagaggaagattatagaagctggtcaggaacttaatgaacatttcctgcaatacactcattgtggctagtgtcaccaactttaacaagtgacattaacaagaggcttatctagctagcctgagtcagttttgtgcctcggtgtgaaagctatttctagtaccattttgcttatagccaggaatagttcatatcaaaactgtggaccagagttcatttttagaggacagagctgctaagcagaaagcgacagggggcccaacctcaccctcctagctccttccctgttgacttaaccttttgaaaacatagacatgggccaggcacggtggcaaacacctgtaatgccagcactttggcaggctgagataggcggattgcttcagcccaggcgtttgagaccagcctagccaacatggtgaaaccctgtctctactaaaaataaaaaattagcggccgggcacagtggcttacgcctgtaatcccagcactttgggaggctgaggcaggtggatcacgaggtcaggagattgagaccatcctggctaacacagtgaaaccctgtctctgctaaaaagacaaaacaattagccaggcgtggtggtgggcacctgtagtcccagctactagggaggctgaggcaggagaatggcacaaacccaggaggcagagcttgcagtgagctgagattgtgccactgcactccagcctgggtgacagagcgagactctgtctcaaaaaaaaaaaaagaaaaagaaaaaaattagctgggcatggtgacacacgcctgtaatcccagttactcaggaggcggaggctggagaattgcttgagcctgggaggcggaggttgcagtgggaggttgcagtgagccgagatcgcgccattgcactccagtctgggtggcagagtaagactctgtccccccacacacacaaaaaaaaaaggaaagaaaaaaagaaaagaaaacacagacaaattcaaagaggacatggaagcttaagctagaagacaaagaggaactagtgaggggtgtgtgacatcagccaaagctgttggcagggatgtgtcctagaaggcagaactttcagcttcctcaaggtcgttccttagtcgttgccactgaaaaatgggtctcgatgggactttgaaaaaaacagacccggcatctagtgagttgctgaaacttgccagctgtaagatctggagtgtttcttttaaactgtaggccggtttcctcatctgtaggattatgtcacactatctaccctgatttcataaggtaatgctatgtgagaatgctctcacttaacttggaagaaggtcaaagcaggatgatgttactttcctcaattctcttttaaagactttcttgagtgctggatgccatgagggaaagcgtatccgaaacactcatgtttctcatggcactgatctagggctcaggggactttgcacatcattgtgttttacctgatgtttaatcccaggcctgacagtggccctgcctcagatctcacgtcagatgggggcgggtggggaggacaaagccttccagcctctgtttctccagtgcagtcaacagaatgagctcctgtcccaagagcctgcaggatataccaacctgagagtcagacttcagcctgcagctccacaataaaaaaaaataaagcaagagtagcccctgcaagacgccaaaacaactacggagcagatcaccatggaaaatgcctcagccagacatgtccaggtccttcagaaacacattgctcatagagaaataagtttttgcaggtgtagtgagagtcaacatgaacataaaccaggcagttcgtcagtggccgattcagaagccggagccaagggtcctgactgagggaactgaggcacacacctttactctctgggtcttagctttaagttggggagagggtgggttagatctctgctttccacaagttctaaaaaatgttcaaaggcattaagtaggggaaagatgatctaataagtttggaaaattctggattcaatgcaatttgcttacttatcctaagatttagaagctattttaagctgaaattctccacggctcccagaaggggtgtgatatgcagttttagcccaaacttaccttgccatgatatcttctttccaggaacgtcagttgtgactgataacatgctggacccgtgttgggaaaactgaactggatgatctcaaaggccttttcccttcagatattctctgactgtgactgcttgaaggaggccaagaattagagtttcatgtcagaggccctcattgctaaagaagtagaggctcagtgtgattgggaaggcccacgtggaactaggtcatccccttcagctgcttcccaaccactgctctgtaattacaatgtgcatccaggaagttatcaaaatcctgtttggagaatattggattagcagaatgtttgattaaatcaataagtggaatactaaggggtttttctcttactaattacatctggaggaactaacctcgtctgtagggatagactaggaagctatgtttcttatgtaaatgaagatagcctaaggaaaaaatatctggaaaaggtaccctttcaactctgatttgtaaatgtcaaatagaggtgctcaaggagaaaagaataaacaatttcatgaaactcaacataaattctaattataataggaatagttgaattcataaattgtgtactctctgaaaagttaaatattagcctgaaaatacaaaaaggacttggatatttcatttttacactcttacatacacacaactttttcctcccaataaataaaacgatatttttgagggacaaatttggcaagttttgcagatgagggtgagaccttattcacttcctcctaaatttaacctaggttaagaatattttcagtcactatttgttgaattctaggtcttagtgttctacctggtcacaatttgtattgagacagaaaccagtgaactcaaatcttcatcagccctcattatcagaaaactttggctggacagctgattgatttgctggttttactgctggcttaatattgatctgactatgtatttcccttggctcgctaaatatatacaaatcaagagaggtttttgatgtcttaaaaggaaacgagtaactgactagagttattgcctaagacccaatatgcaattcagcttaacccacagggcacctgccatgggccacttaatgaggacaccatccaccactgctcatgctgcaagctgccaatgcccttcttaccccttcacctcatttaccccattatctgtaatctgaaattaccatcacctcccctcccactatattttttatccctctcttcttcctcctcacttcccatgacgacacctctgcttcaggtcctcatttcggttcagtagtctcgaaagatctctcttcccattctttcttcaaatgcatcgtgtcctcctcagataaaaagatctttcttgtcttcagtgggtttccactgcctaaaggataacatccctattccttattcatcaaaaaatcttccattgggtggccctgattatctggctttatccctcactgggccaccaggagatgccacacgtgaaaccacatggcacagctccccctcccggtatatacagcacgttgttgtgtctctgccctttggtcaatagtattctctttccaagaatgccttccccacacttttcttctagcaaaacattgctcattcattcaagcctggctcatgttgctcctctgtaatgctatcctactttgccttaaatgaccactccttcctttgtgttctgcactatattgtttatatcgttgtccgttggattcatgcatgtctcttttgtcactagcagtgatatacataaacatcccaaaaaaaaagtagctctgggacaggaatgtgtcagaggccttagaaatggtattttatttagtctttaaaaataagtcatgttattatatacctcatagaaacaggctcacagaggagaaattgaatgccccaggtcacatagctggtcagcagagctgggattcaacccagctgctccgtgtcaccctttgcattgcttcctgttacttctccactgttatcccacctgagcctgtgtgccttcctggggattagtcaatgtgagggtggctccaatactgtgtttctgttgttctgaagggctctgttctttgttcatcctttgttaggagatgtgaagacattctgagggagtggaagataggctgcccatcctcagggctcaagagctggagagaggggataaatgaggaagtgctttgaaagtggacacaggatgacattagttaggcatgaggcataatactgctgggagaatacaggaaagtcattctccttcgacttcctcacattatagtttttgtacaatttggagttaatcaaagagtagataaaccgagaaaaatgtgtgttcaacaggaaaaatggcagggtggggctgttctaaacctggggcagcagttccccactgtatctgggacagagtcatttaatttcagtagtggcttttgaatctgtgaggcccacttgatcttctactcctatcagctcagtgactcattctcccggcaaagacttggcgtcatcccagggaggcagagaggccaactcagtggtacccacaggaccgagtgagtctctcacaggctgcatccacgccccccatggcctctgctaatgaggtccacacctctgctcagcagcctgccaatgtgatgggacacaccccatgctggaagagctcccaaaccagactttgtggaaacttgtggctgcaggttcaaaaggctaatttggttttccactgtgcacagggctgccactcagtgcagtcttcagattgagaacacttcctcccactatgggcagtttggcgtgaatgagtgagatacgtagtttctggatagcacccaggggaatgccgaggatgtgcacacaaagcaaggctgactgttcctttgctgtttgtctactttttcccattttgtgctgagactcatctttccagcacaaacaccagggtgaggaattggaattttagtgctggaagtctccagaactatgatctagtgctcattccctctgatcccattgccctgacattatctgatgcttccacagctccttgtacagggaggtgtggagttgggagagcagcagcctgtggtacagggctgcccacagggaaggaagaagacatggcggggacatggcctgactcccgatgtgctccttcctgtagggtcttccacatggctgggctccctcccgtcccagcacacatcctgggtccatgtgaccttgagcttcacaaggtcaaatctgtgcagatccaaatggtgtgtggatctaattttcttcctcaagaagccttgcacaatctggccctgcatgcttcctctgagcccacacttcctgtgagcatacacttcctgtaagtgtatacttcctttgagcgtacacttcctgtgagcttacacttcccatgagcttacacttcttgtgagtgaacacctcctatgagcccacatttcctgtgagcccacacttcttgtgagtgtacacttcctataagtgtatacatcctgtgatcatatatttcctgtgagcatacacttcctgtgagcttacatgtcctgtgagtgtatacttcctgtgagtttacacttcctgtgagctctcacttcctgtgaacccacacttcctgtgagtgtacacttcctgtgagcacacccttcctgtgagcttacacttcctgtgagtgaacacttcctgtgagcccatacttcctctgtgtatacttccagtgagtgtatacttcctatgagcccatatttcctatgtgtttacctcctgtgagcccacacttcctatgtgtacacttcctttgagcccacattgtgggtgtacacttcctgtgagcacacacttcctatctgtgcacttcctgtaagcctacacttcttgtgaatttatacttctatgagcccatagatcctatgtgtatacttcctgtgagcccacatttcctccgatggtatacttcctgtgagcacacacttcttatctatgcacttcctataagcccacacttcctgtgagctcacacttcctatgaggccacacttcctatctgtgcacttcctttgagcatacacctcctatctatgcacttcctaagagagcatgcttcccgtgagcccacatttcctatctgtgtacttcctgtgagcatacacttcctatctgtgcacttcctgtgagcatacacttcctatctgtaaacttcctgtgagcatacactttctgtgcacttcctctaaacacatacttcctctctgtgcaattcctgtgagcccacacttactatgatatacacttcctgtgagtatacacttcccatgagccccccttcctctgtgcaattcctgtgagcacacagttcctctctgtgcacttcctgtagcaccactttctctctatgcacttattctgagcacacacttcctatctgtgcacttcctgtgactgtacacttcctgtgagtatacactttctgtgagcccatgcttcctctctgtgcacttcctgtgagtaccactttctctctgtgcacttcctgtgagcccacactttctgtgagtgtacacttcttatgagtatacacttcctgtgagcccacacttcctctatgcacttcctgtgagcacacacttcctctctgtgcactttctctaagtccacacttgctgtgtgcattctcacctgcacaatcactcttgctcttggggttcttgcacatgattctttaccaccccagaactctggaaggtgttgctttctgagacctacctctcttgtgtttctccaatgccagttcatccatagatttcttcctaaataccactggcctccctgtgcagtgctttcactgggacctgtgttttttcttggtggcacttacatagaaggattgttgtttaatgacagtcgactccaagactgtcattggtagatggtggcttccaaaatggcagaaccaagtcagccttgttctttgtggtatctccagggtcagccttccctggtgttcccaaatgttccctaactgaaaggatgtattacagttgggcttcctctccctaggagacataattaaatttaaaagtgggcttgggttgtttgtagtatgcagttttttacaggggaaccacagaatctttattccagatttttgaaaaggtgcgcggtgcatttcatttagtccggtaagccgtatttttgtgttctgttgtcaatacattttcagacacacatcacttgcgaaactcctaaaatcttttcaaaatgctctcacaagcacataaacacatatcttcttccttattactcaggcacttcagacccagagaattgcttttagagatcttgatcataatacctcaaagacagttttctttaggaagataaagaacactaaaatgttaataatagaaccttgagaccctctgaaaagaagacttatgtcagattgataatttaggtagagttctggaaaacattaatctacaaacatatgcctgatagaaggatatttgcagaaatggctgcaagtgcaatattgttccagctggtgagtgtggtccataaaaattcagtctttaaaaattatagtatagtctaattgtaggactgtgtgctcagtgaaaatgcactttacctatagatagggttgggagaaccaccctgtcttaccacagtgtatgtctgctcaacacactgccatgacctgggaagagaactttagggggacattcttatgaagcccttccctatacctttttgttagttccttataatcccagaaattttttattagggtagataaatgaccataaaacgtttccaccccgttgaggatgtttcttaggacttcttttatgacaaccatctaaactcagccacatctgcctctggcgtgtctagtttggggccacctctttgcatccccctgtgtaattattttatgagtgaagtccctgctggaaaccagccctcttcccagtcaaaatccatctgtttctccactgcctgtacatgcctttctctttacaatacagttagaccatttgagtcaccttctctagagagataacacaaaagcagaatcacagacatgtgcaatcttccagtaaatgtcttccccccatacaccatgtatggggttgaaaaatggtatttctataaaaaattggaatctgtgaagacagggttacagtgagaaatattaatacacacattgcagagcaggctggtgtcaggttctgtgccaagggtctgtggtgcctctgacaaaggagaacaatgctgaggggacgaagcagcaggaggagatggtggggggggtgggggggtggggggggtggggcgagctaattatccaaattggaaaaggcccaagccccttggattaacacacatcttccctgctgaagaaagtgctcagggaatgatcatgatcagctgccatgacctccacttctcctctcacagggcaccaaaccaacatgcatcaggtggatggctgttggtgatttacatgggaaatgactgtggtatgcagggatgcaaaatcagtgtggcttcttcctccagaagtatggggccacccttgcctcaactcataagaatacactgatgttctggtgttgcctcagaggccttagcttacacaattcctggggtcagggttgggtctatccaaccctagggtgtttctgcagaaaaacatagaccagtgttcctaagatgccagcctggcttctgctcccaatctgcttcctctgaatcatacctcttctttgcaaacgaggtgtttttgtgaacagaaaatatgtggacttgactgcttcatttactctctcagaagttcattaaaagcttacatacacaccaatcaaggctttttatgagacacagccaagatgttttatgtgtatggtgccaataaacacacttctccagaaggaactagtactatttatgtaaagtagacacttaattcaactgaatggaaatagcaaattagagaatgcttgattatggcattgaagatgctttctgggatgaagacattatttggaaaatctccagatgctcaaagcttgaggaatgctgggatcaggcaggtaactctgtaatagaattggacagagactaattctgctcaagaacagctcaaatggaaagctcagatccacagggaaggagccaacccagtccctttaacttggctatggtggatcaagatcgtcactggaactctttggttgtgagactcaatatttattctgtgtaggcaggagcatattggacccatcatgaaactggtactgtcataggctagacctgtgacctcctaggtgaaataacaaaggctggaaagaggtgtccccatgggctttggggaagacttctcttgcccaacagtgagcttgagcaattacttttctaaattgattggtttattaaagaaatattaattggacaagacaaccatcaatgtgaacctagttcaacacaaagaacattcaggccatcagatgaccaaagtgaagcttcctggtacttagcatctgccttatcaactcaggcctgacaaggaaacatgtcagttgctggagaaacacccataccctaaacacctcctgtcacacagtggcaacctgaattactgtgaatccatttatgcggctctcttctctaagagcagaggaagtaggtgtggccagactcagaggaggtcctcaagcaggaggtgtacaagtcagggttctccagaggaacagaaccaatagaaggtagatatagacagatacagatatataagaggggatttatcagaggagttgtctcatatgcttatggaggctgagtcgcatgcaggccatctgcaagctatagaatgggggaagctggcagtgtggctcagttcaactctggaagcctcagaaccagggaacctgaaggtgtaactttcagtccaaggccaaagtcctaagaacttggggtgccactggtgcaagtctcagagtccaaaagccagagagcctggagttctgatgtccaagagcaagagaagaagggtaccctagctccaggagaatgggaaggagagggcaaattcacctttcctctgcctttttattctatccaggaccttaaagtgattctaatgccagtctcttctggaaacatcctcatagacacacccaaaataatgctttaccagctatctgggaatcccttaatcctggcaagttgacattggttaataaaattagccatcgcagtgggtcagggagaaggtggccgagtgtctgcttcctgtgcggagggcaccacaccttctgaatgacttcttggtccctcatagcctaagaagtccggtgaaatgcatttgatctcttgactactttttaccccatcagttgtaccatccaccttccagctatcttcccacttcatgcccatgattccatgcactatttatgctggagcactacaactaagaagtctcttttgcatttctttcttccctccagcaacacatggccctttatgcagctctcacagccagtctgtatgagagacagaaataatggcattgcccttgggaaaggagaaacagataaagattccttctcttgacttctagcggcaagcagtgacaaagtgccccacaaaatttaaagcatcaaggagtagcccgtgggaagatatccatcagatcctccaatatgtgaattaggtctgatggggggtagctgctcactggtcatgatatcttgggactcctgcttctatccagcccctacatcgctctttcatgattttaaatgtgcactcaaggagctcactccaaatccaagcctacatgtatgcctaacctactccaaccagagagctccatatttatgtgaagaaaagggccatatctgattaaacaaccatgattctgtttgcaaacaccaatccacacattatgaaagacacagcaaatgtccccaaataattgattttattcacaccaagtttactctgacggattaccacaagtaaacatgtaaacatgggtaacacttcactatagtatagttcatgccacttgcctgatagaaaaccatggagcttctcttaggaatccattttggttttggggtttgtttgtttgtttatttactttttttatattaaaaagagagatgaggtctcactatgttgcccaggttggtctcggactcctggactcaagtgatcctcccacctcagcttcccaaactgctgggattacaggcgtgaaacactgcacccagccaggaatcctttaaagtacaaggaggattcagcttattatagagccagtctatacacaataacctgaattatatacctaacatgatctaaatccttagagttttagaaacactcaaaaatttttttaagcctcatttctaataataacacagtgattaaccacaatgcttggcgaattgcctcaaaacctttttggaagtagggaggatataaataaatcagttaatacataaataaaatgcttgcagctcagcgaccttctggttctcaggtttccatatatcaaattatggattgaccccgctaagtaatctccgaagtcttttctatgtagaagtctataaattttctgttaatcccagggtgagttggggaccattttgtcttttgtccttgtcgactgtctttgtgagaagctgagtctgcttacctgctgggttcagtgagcaggtatgaaggcatcatgtatggacattgaagagttgcccagagataagctctcacgtttggagaagcatgggtgtgtgggctactgttggcttcagcttgtgtacaaggatattcaattttagaaagccataattaatagtttctcttcttaccatattgaagaagtcagcttgttgccttctggcgaattaaaatttcattaaacttttcagttaagaaaatacagcttgttgcaaaaacaccatatgcaccttacgactcttttccccacccctcctcagtgcgactcccatcactgcacaggtggaggcagtgaaggggatgccttgctttctgagctgctgaaaacatcagggtttcagttctgtcttgtttactgctctatctgatcaccttgcattgtgcttggcatgtagtagctgctcagtacataccatttgaatgaacaaatcaatcaattaatcagttaatcagccagtcgatgcaggtgatgcctgttcctaaattcctttggtcccagtaggtactttgcaacatttccctttcttctgcttctgttagaagggacctttttaaacttgaagggcagaggcccccacgcagctcatgcagatggtggtactaactggagaagcagttacagttgtacctagcatgcatttctgttggagctcatttcaagtaaatgacttatactttatgtccacagcaaagaggcccacatttgtggcaatcttggtcagtacagtcaggaaggaagtgtagctgaagatcactgaggaaccagagaaattagtgtatatctggatttaatgatcaatttgcttatgttaaaaatacatttgaatatgatttactgcccttcagttaatgctagttccttgcttgcagcaggaccaatcaaaaggagctaaaccttaaaacccagatggagatgttgaaggattctagctaaagtttatgcaattaattaggcatcccctattcagaatacactttctatttgtgcttagaattgaaagatatcgtactcccaggaaaagtacaaagaggaccacgagatacattgataatgaccttatccttaattcattccacacatactcagttaagtggcttaaataagtgatagagattttaatttaaatgcgagaatataaatgggcaaatatttgaatttaagtgaaattaacacaacgtgccaaatattgaataagaaactggaatttagttggcattggataatgtatttggtttgagatttgggtttccaaactgaatatataaatcaatgggcagatatacagtgaacacaaatataaataaacacagttccatgtttactgtttataatacgtccccccaaatatgtgcagaagtggaatgtgaagacaataaacaacttttttgttaggttgggggcaggggattctgaaagctacaaaatatcaaaccatttattcattgcatcccatctttaagatacagttttcatcaatatattttcaatgtttatacatgttacttagttctgttctttttctactcaaatgattgtacagttgattaatgtcacatggacttccattgtgattattcttttagctctgcctattcacattattaataaaaccatgaaaattaaattaatatgaccttatcattgtaatcactactttcatttttgcatttttctactcacttttaccaaaaaaaaggaacaagatgggaaaacaaaaattacataaaaacttcagcgtatggggaaaaacagagttgtctctaaaaaggatctgctctcggcatggtagcatcagagcatctactcaattgtcagccataaatgaagttcagaattggacacaccttcacagtcttccatatgccaaagcggattgttccaacatcagatgactccctgccatgtattccttgttagtttcctatgctaaatactagtaagataccaaaggatgttagaaatctgaggagaagttgcctaggatttagagatcactcctagtctaatatcagtaggtttttaggattacaggttattcaagggctgcttcctgtgtgtagaggttgtattatgagtcctgaaaggagagagaggaaaagagtctgccgtattcagaataaaaaggcaacaaagacagagtgttttgcggattgccagataagtcttttctgaccgttcccaatcctgaaagttctaacatggagactgcttggtctttgaaggaggtgaattgcagtaaacaaatcatgaattatcatctgcagtagatttgaaagtctttgagtgaatataactgggggatgtaaccttaactttcagataagtttctaaacagttcagcatatcattttaaaatgagcaatggatgtttaatgaagaaaatatgaaattcaggttatcatgtaaattacaggtaaacaaacaaaagggaaatacaaaagtgacctatactctaatcacccaaacagaatcactgttaacaagttggcaaaattctttctgggatttcctaggcatctatagtccaacttagctctatgtttatttaactacatttatgcatacaaatacttttctttacaaaatggtgtgactttattctgtaacctgctgctttgcatagaaataaatgatgagcatgttttatgtctctaactacacatttatcttgtcttaatggctgcttggcattcatttcttgggctatagcttcacagatttagctactagatagtctccaattatacgcaatagcacatatacctttgtgccgttttttgtacatatatctttgtacattcattaaataatttccttaggataagatttttcacaaattaataggtcagaagtatatatttttaatacatatgaggtgtgttggagaattatcttttagaaaatttatatcagtttatattctcaccagcagtatatgagggaatctgttctaatcagacattctcaacacaaggctttatcattctttttaattgttgccaacctaatagatggtagactctactaatttgcattttttgattacttactaaggttgaatttttttcatgtttattgacctttttctcttgcctctttgtgttcatttagccctggtatttggtatgatttctcctaatgctttgcaagttaataacttattcattaattcactcatttattcatttattcatttacttatctacatctctttcttttctgtgtgttgtaatctcatcccccccatactctgagctttaatttgatttatggtattttgtggcatataaaaatctttccgttttatttagccaaatttaccaatcttttcaattataattttagacctgaacaatttgggatctctgtgaattcagttattcatctgcatattcaagctaaaatagagcagtggcttagaaaccatctttcctaaaactatgacaatgccatttacagtaagagtcaatgaaatggggggagagtcattcaatgttcagaatagaaagatttagaagaatggcaaagttgagcatcatacctttatgaagtgaattgtgtccttctcaaaatccttgttttagccctcacctccagtctgactgtatttgaagataaggcgtttttttagggttacatgatgtcataaggatggggccctaatccaacaaaactgacatccttataagaagaggaagagacagcggagcttgctctctctgccctgtgaagacatggtgaggagaaggctgtctgcaaaccgggaagagagccctcaccagaaaacaacccctccagcaccttgaccttggatttccaggccccagaactgtgagaagttaaatttctgttaagactcccagttatggcagccaagcagactaatccacttaggctgatgcagtcaccagttctgctgggcacaattctaagatgcctcccaaaatgctcacttggccctggcgcctacacaccatctcccagttgtttactcaagcactgatttcagtgctgctgcaatgggatttggttataattaaggtcctggatcagttgccatccaaatggggagataatctgggtgggcctatttaaacacatgagccttgcttttagaaagacccctacagctagtcacagaggaggcgactagagagactttggatggcctctaggaaagcagacctccttgtcatgaactgcctgggggccacatgtaaagagctgcaggtgcctctagctgagagctaaaaggaaagaaagacccgagtcctaccaccacagggccctgagttctaacagccactgagcttggaagaggactctaagcccaagaaagaaatatagcccagccaaactcatgggaccctgagctgtgagtccgtttaagctgagcctggacttctgacccactggaactggaagataatgcatttgcattgtcttacactggtaggtttataggattttgtcacattgaaatggagagtgaatgtgtcagtgtttacatccctgcggagcaaggagggtgccagctacggaggtggagtagggggcctggctctgcagctggggcatcgcagacagcggtttggctaacggtgcagctgatcttcgcaagttcccaccctgctcctcatgaaacacagttgcgcctcgaacaatatgggcctgaactgcaagggtccacccaatgcatattgaaaatacagaattgaaggaagaggaaggggagtcccgcatatacagagggctctcccatacagatgagtggaaatgccaccgggtgaaatctgttggaacatccatacagaagcaaaatattagggaaacaacaggttacagaatcctccttgaacattttttctttcagagaagtcaagtgtgtaggtatttggagctaggctaggtgataagagggacgtaaggaatgtggtgtctgtcttacatgtgaatattgaggacccagtatctacagccacaaagtgacgaccaggtatcacccagcagcaaacttctgaaagtcacgctctgagaagcctctgcctccgatctggggccttcacctttccaggggcccaccccatccctcctcccagccttctgctacctgtctctccacttcttctacaagcaccctctccaaaactgccacatgttctcctgactttgtgtctctgtgggattgcctctatgatgtatcaggaggacgtgtggttcaggggccaactgaaacaccatgtcctttggttttttgtgaagccatcccccatttcctggaaccaaaatagatcccacagcacttcctgtgtaccctgatacctaacaaaatgttttaaagattgctttagctggagattcttacatatgtgtgtcctcctgggacagtgagtccggcaaccaaccctcgctgattctttccctccctccctgcctctcgcagcagctggccaactgccccttctccagcaggtgctccctgcaggcttgtgaaatacactggagggcaattgtctggctcagactcatgttgccatcagcaaatgaccacgtttaagaatgttatgccacctctatatttggcctgcattattcatataaatatgcttggtagacaagggacagaaggcacttgtgtcggagaaagacagtttaaagggcaacgacctaacacactataaaatacagggagtggggagtggggtggagggagcaagccgcgcggctgccaggcagggccctgctcccctgggtgcacttcctccctgctcccgtgggtgcacttcctccctgtccagggagtgcactcgcttcattgcccagtgcgactgggtctgctttgcaggggccatatctgtctgattgtgcttgggcagatttctcttgtctccacctagctggggtgattcaagtaggaaaaaagaaaaccctcctgcacagattgtgcgatcatttcatttccttgcctttgtttgtcatttctcctgtctgaaaaaacagggaatccactaaaggccagaacattgtactctgcttccatcctcatgaaatcttggcttttctttgcaggaagcgtccaaaataacacaggattggtcctggggtcccaggcaaaagtgagaggtcagaagggtctccatggttctcactcctctctctgtgaccttcactagctcacttccttcctgcccagttctcattctctcgtccagtcttttctttgtcttcctgtggatgaatacatgcataaacataagaataaaggcaaaagtctcaatggaatctatcaaactgttcattgttaaccactttcctgtaggttgggtgggggaggttttactttcactttattcatttccttccttccttccttccttccttccttccttccttccttcctttctttttctgtcggagtcttactctcgctcagactggagtgcaatggtgcaatctcagctcactgcaacctccgtctcccaggtacaagtgattctcctgcctcagcctcctgagtagctgggattacaggcacccaccactatacccagctaatttgtgtgtgtgtgtgtgtgtgtgtgtgtgtatatatgtatatacacacacaaacacatacctatatatatatatttaatagagaaagggtttcaccatgttggccaggctggtcttgaactcctgatctcaggtgatccgcctgcctcagcctcccaaagtgctgggattacaagtgtgagccgcagcacctggcctattaatttctgtatttgattttttttacagcacatgaaatagttttgatgtttaaatgaaggaaacaaaagcagtgctttcgatagcccaagcttatctttcctaaatgaacccaaacctcacagttattccctttacttcccactcccgatcacacttgtcccaggtggatcacgtccgagaccagcactccatgaattttaggagccagagcggaccgtgaaggtgtcctggtagctgaggtcctatggccgctcatgaaattttagtgagccatggcttccctgaggctgtggcccgcaaagtctgaagggagtcacctccttcaaatccactgagcaaggcctggggagtaatgggaggtcccccgtctgactcacacctgacagtcgggcctgtcccatctctggcaccagcaaccgcccggggacggtgagggaccatggggtcagcctcagactctctgcacatgtttgctggccaacgttccagccagcgggcctggactggagggctgggatggagagggtggggcaggaaggcagagcctgccctgagggaaccgggaggtgttccgcgcaggctctgctgctttctgacgtgtgaccgtgtgcacaggatttgtcccaagtcccacctgcctcttctggaaagtggagcgatgatgtgagcaggcacagaggtcacaaggagaattcagggatctagagacccccagagcttgccctgtgcccatgctgcagtgggcactctcctggcatggccacgtctgtcacgcgtgatgctcacagcctgctcactactagaaggctttaattttctgaagcagtgatatttaatttatttgaaatttcaaatgtcattaaaggagacgtgctatttttaggctaggaatttaaaatgcttccaaaatgcctcatccccatcgctcttattgcaagcatgtattagctgttctcacgcctgctgagaatgccctgtgactgaagcaggggctgcttctgggggacagtgcagccaccatgtgggtcaatataaggaaatcaggatgatacaagtgatgtgggtttgcaccatcatcctggctgctctgtgtgctgacgtgtgtataacattgacacgaggatgcctgtagcagatgggggtttagctagaaagcaggaggcagtgcacgatgagtatggtgcagtatctccagcagacctatgctgggcagaaacctcacagttctgtccaaagggagcttcatccctccgatggccattcccctgcagtccgtgaacccccaggatagctgcaccgcatcagcagaacaattgcagtgcctttacagtgaaggaacacaggctccagctgtcagctccatctcaaaacctacccaccccactcatcctgcacacgctgccccagccccatgccccagaggctgcccaagcacctagcgaagccctccaggatgcttggctctgggcctgttgtttcaagccctgccctgccttctggctgctggatggggaattgcagtgagattccttccctccgaagctccatctggtgcaacatctggagctggtcccccagcataggaggatgtgagtgggatgatgaatggcacctcagaagtgtgctgttggggagggcccacctgtttaccaacatgattgcaaaacttaaatagctctggggattctgaactgctcttcttggggggctccccaccgagagcattttaggccctgtgcatagcaggattataaaaaagtcatatttaagacttgatcatgcttctggcatttggaaggaaatggatggatgaagaagaaacagaaaagattatagagaactggaaaacaacaatttaactgctaggatatgaatcccaaatgttataggggaagttctgggatgaagagaagacggagcaatggctgccactgactcagtgatgtgtaggacatggggaagccgggattgtggacactccccaccgtggtaccccccgctccagtggtaccctcccccgcccccggcatgggcagctcagaccaccgggaaagttccagcaggcagatacattgcttcccacacaagctcattgggagaaggcggctctttttttctcattgttacaatatgatttgattcgtggtgttgtaatgattagcaagcagaaccaatgtggtttctttccccagcatcgcttgaatctacagcaaactgtccagagaagggatcacagtgggattctgatgccttattatgatgtcaccttcacgaggaggtttagaggtttgcttttgttttgctgttctaagaaaaaagaatgtgccatttggacatttcaccttcaatttggaacttaaaaatttagtccataaacaggaaataaacagaacttttgagagctccctctctcatttggcaaggccccccacttgccctcagcacttgggcacccaccttgacttacagaggaagccctggaaacagccaaggatgggggaaaccaatcctgggagcacaggggtactcgcctgccaacctgctgacctctgggaccaaataccagggctccgtggagacatggctttttctgggaggatatactgaaaaacagagcaaaaggggaattgtttgctgtgtgagattgccaagtcagccctaggaaagaaaggcccaagggcacatctgcagaaggactggagggtcagtctgagctcatatttgccaagtctccaaagaataggcatcttatggtctcagcacgagggagaagagagaatttcacctaggatggcttccagtaagcacctgtgatgtctgggttctctccattcccaggcctgagagcggctgcacagtcctgattcctggagcgctggcccaggccgggtcctccatgtcaccccctttaatatctacatttattcatgcagacgcggactctgagcaaagtatcaggagcctggtgattcaagttgggagaatccaccaaagtgctttccccaccaggattcactcacttgggcctctttggaggctcttcctccccactctcctcttaaaggccaggagagaggctggcaaggtcgcctgtctccctcctccacacctgttcctagatagctgcttcctgccgggactccgtgatcttgtctgcaatgggtccagatctgtagactgtcatctaacccctagattcctacagcggactgactaccattgtccgtgcatagcaagcttgtccctaaagctcagacgatggcctccccagtgcttccccagaacccgatgtggttttcagtagaggcttcttccatggaagctgccaatatgtgtcccacctgccggcattagacctggggcacctgattgcttctgcccgccccaggatgcttgccccaggcctctcccatccatccaggtcacctcctccctagaccttctcagcagcccctggcttgtctctgagctgcgggctttctgttcctggactgcccttcaccctgtccccagagcctcctcagcactgatctgattttgtcactgcattcctgtgcttgtaagcctgtgaccagcaatactgtcacttcttagaaaacattttggtctcgacacggttcacacaggcaatgccccgccatcattgcttccaattgtgttcgacgggaagcagacagtagcagcgacggctcttggtgctcacccagacctcccttgctgggaggttgccccaagaccctgcagcctgttactgatggaggcaggtacacacatagccatccccttgccctccctcagggaccagctgtgaagtacagtgcgtgcgtgcacttccagatggcattcgactgcagctggtctccagttgggaccacatcagtgcctcccgtctcccctaccccaggccacttccctccctcctcctattaacatcatgctccccaataatccccacagccccgcctcagcctctgcttctggggaacctgacctaaggcaacagcaacatttccctggggctgaggaggcaggcatgcttttaaagaggcttttccatcacctttgagcatcacctgcctacgagatcaaccccacacatttgagtttggcacatgacacattgcacggcctggcacggcctttctttcctgccttcatctttcgcctctctatgccctgttctttgagcttagcctggggttctccacagaaaccacactgttggactcttttatgccttggtgcatcctagatgtcacattacagtagtttggagagacttttcttaggtgtaagtgagataaaggggttgctggaggtgctggctacagggcagtgacagagaaagcagtggggtaggcttgccacatggaagagagcaggtgaaggaggagacataattttttcacaggaggcagctgctgcctgtccagcacatgaaccaggggtacagggatggggtgcgaccagcagctaatctaactggtgtatcttcacattgcatgttaccatcaggatggagagagcaggtgctctctggaccctctgtctcccagcctgactcttcccaagactgtgagcacctacagagcaggcctcaatccataaccttggtattcttgtgttgagttttatgcccgctgcaatgctagactgagatgcctcttgtatggaaaatatttcttaggagtttagcaaatttatgtcattggctgatatttcaggccaatccattttgggattagaacattatcaggatgtaaccttagagttcacttagttccggcaaaacctcttaacttcagttccctcatctataagaataagggattcatttgtgatcatatagctcaggtaatccaggaccagaaacccaggagcgtgggacctgatccacagctagaggatgggggactctgtagctacagcattttcctgaacacacaagaaatccagtaagcagcacacactggctgagtcggctttccaatcagaaacaagcccttgacttgccggagttggaagactgcaagtacctgcccaaatgtccacccaacagataaactccctgttacgtacataattacaagcattctttacctgacagtcccatggctggacaagccaagctaagttttcagtgtacataaaaagcataaaacccgatgaagtggcctgcctaaaaattaatgtgatggccgcaattgcagcttttgtggccctgacgttagtctttgaacgagtctgccttctgggtcaagtgaacttttactctgggattatagaaagcaaagtaagtgatctcaactccctgccgcttatacaagaggggagttgttacttttactttattttattttaagatggagttttgcttgcccaggctggagtgcaatggcgggatctcggctcactgcaacctctgcttcctaggttcaagagattgtcctgcctcagcctcctaagtagcagggattacaggcatgcaccaccatgcccagctaattttttgtatttttagtagagaccgggtttcaccatgttggtcaggctggtctcaaactcctgatctcaggcgatctgcccacctcggcctcccaatatgctgggattacagtagtgagtcactgagcctggccttattacttttagataaaaggcacttgttacatcagccatttcacatccattgataaagatgggtgcttctgaaatggccacagctgacagccaatacacctgcaggtccaccctctgctggtcattttctgaccacagtaagtgctcagcagccatccccagagcaggggtcagcaaaattctacatcaagggtcaaatagtaaatattttaggctttccaggacctacagttttcctatcaactactcaactctccttttacttgaagcaatagtcaacacatagatgaacgggtgtgactgtgtaccaataaaactttatttacaaaacaacagcaggccccggggccatagtttgctgactgccgccattgtgtagcctgaagtggagctcagaagcaggggctccagccgtgggtggcaaactctcaaacccaatgacaccaacagtatctttggttagagcatttagagttttagccatagttcaattagcagctgatgatttgttcctcgatcagcccaagcatgtgaaacataattgttccttcaattcccatcagccaggaggtgacagggaaatgacctattagctgacttcaggcagcaggaaaagtccaaagttggctgctgccattgccatattgattggtgatccaagagaagtgtggtaactatgaccaagaagaaaaggtctaggggaactattccttatattgtggaaatattccatacttcgctgggatattttcactgaaatcgttttgaactgagaaccagggccattcctctgactgtaaagctttgtagaatatattcaattctgcatgttactgatgggtgctaaccttttgtgtgtgtttgtgtgatgttcgggcttaagggatctctggacaataataatgataattcagctgcctgggatcttgatgaaacccatccactccttcccacctttcccatgtcagatcttctacaaagcaaactgatgctttcagtaaaatattactgatgcaatccaagaaacagaaaaaacagcccaccaatttactcccatttgaacccctgaagcctgttcacagtattaccacattgttattgaagtttacagaacaaaaccatagatggaacccaagaattcttctagttcaagcccattttagagctagattgactgaagtctaaggtgatgtgatctatgtgatttccccactttcaaatatctcctaagaaatggccatagaatgtatgagatttctttttaaaagaactttactcatactgcatacatgcatgtacacacacacatgcatgcacacacaccaaagctcaggatctcctttgaaggagtgtcgagctcacgaatggtaagagcccgtgtggctcaggccctctgcagagccagggcagagagacagatgccattttggggacaatttaggctgcacagctgctctctctgaactgccaacagctgaaccaaaatgctcaggaggtgggctgggcagccctgggctgtgggcacagtgtccttgggtatttacaatccctcgatccttgcctgattggttttccataggcagggcttcgtccaagttcctagggtcgcaataccattctcattagaaggttcctcttgagagacaccatggagcagggaaggtcttgggtgtcctcccatctcatttgcccttcccctaggtgcctgtgtttcccatcccagtggggatccaaagcatgtcctgggcattgggtaagggtttagaaccttgtccccgcctgcatatgatagacatggggagggacaggatcaggaggttgctaggtagagcctgcaggtgcctttccctgaactctgttatgtggctgagttcttcagagaaatagtcaggagctaaggggttaaacaagcatccctccctgcagagacaggcaggtcagaggctgcatctgttaaattagggtccaggccacagaggtaatacctaccactctaaactgttagccttccaatactacactccagttctgggagtgagtaactgtgtgtccagagatagaagccataagcacttgagttacagaactgctgagaaattggtctgatggtctagtagccttgtgccaggagaacagttcctatgtagaaactggtcagcattttcttctgaaaacgtaatcatcattgcagtgagtataaacttccatttatatgccaggaacctataagtttcagaatgtgtctgatccctgaagatgtcccttctctcagacggctggcccttgccccactgttgctgggttgtgtataatctgtatgtccagtcaacctcagctctcagcctctgagcccaggggacagaaggccgtggctttaaatgttcacttaaatattgtcaaggtagtatgtttattgtgtactcccaatggttgtcttagaaaaccaaggatggtgtcatccttagacctaaggggccccaggcctggcagtgccttccttcagagttctaagctccaatgcctgtgtgtggcctggctcacagagccatctgagcaggacccctgagcccagcctgtcttcccctcttggatgttctccaaccctccacccacccgccccatgcatgagtcaaccagatgccctgaggagctctgggacttgcacctacagggtcatcccgaggccctgtggccagataggcaccaatcccaggagagtggggaggtgagctcatctcttttgcaggccggcatggtatttctttggcaggatgctgtgagactgggtcccagaacagtgctggcctgttcattttggatgactcaaattgctttttaaacaggagtcctgaaaaaagtatttggccaggcccagagtactataggggcagccctgaccagggaaacattaatataccctctcccaaaatacaaatctcttttagactgttgccagcagtctcaggaatgatcaatactagtggttgagactagagggaccattaagtaagtggagttgatctttattggatatagctggccctctttggtaagatgtgatcagaagagaaattcaggcagcaggctacataatcttcatagaaagtaaatttcaaatgcatcatacaaaattcacagacaaacacatataattgcttaattgcttccttgtttaataaaatgtctttcctgatcaatacctcttaacaagttgaccaaaccaggtatagtttagcctcctgatcagatttagaccttgaatttaatggaggtatagataggtaggtaggtaggtaggtaggtagatagatagataacccatgaatgttgaagaattgtgtctatattaaaatttagccaaaggagaccagagtaatataataaatttgttcctatgggaaaagcactttaagcaaacatgtgccccattggtgggtggggaggtatatattggtgctattttttgtacagcattacattgtttccctggtggggaagaacaggttagctttataattttgggagagcaatttaatttaaaagatataccctcactgggataattaaatcctgatgtgtgaggttctttcaaatggaagatttgcttaaggtgttcacattttggttattctgaacatttctacttgctgtgttgcggagtcacgatactgaagggcacacatgtttttgtatctcacatatgtgacacatccttatctaaaatttcagagccaagagaaaagaaggaatcagatagtgataacccagtgaggtatctgctgcacagtctgcctctccaactttgctgaggaaactcgaaagtatggaaagccaggagcccggcacaggtcccttcccagcttctgtctcttagcctggcagagacttcagaggaggaactccctgagaatgggaagtcattctctagttgtcttgtgcttcgtgtttgtttttcattgtctttttcaaagtaatgtatgcacaacgtgggtaacactgacttttattggctcatagtgacaaaaacaatagtcccctgcctctctcctcctgaactctggccttgctccccagttgctaatatgttcaatgatttttgctatttcttaccaacaactactttaatatttctccataacatgcttaaatatttgtacttatttgggctgggtacggtggctcatgcctgtaatcccagcactttgggaggccgaggcaggcgaatcacctgaggtcgggagttcgagaccagcctgaccaacatggagaaactccgtctctactaaaaatgcaaaattagctgggcgtggtggcacatgcctgtaatcccaactactcaggagtctgaggcaggagaatggcttgaacccgggaggcagaggttgcggtgagctgagattgcgccattgcactccagcctgggcaacaagagcacaactccatctcaaaaaaaatatatacatatatatgtacatatatatatgtatataaatatatatacatatatatttatactaatttatttagatattatgcattgctttcctactgtaatagatgaagattaactcttccgtattacttttcacccaatttcaccttcccccatactcccatataattatgtttcaattttggttaaaccaatatgagatgattgcattgttgctgaacaagaggtacaatattacgttctctttttgtatacaaagactgttaatttagagacctagagctttcagatcttggaggggttcttctatctcaataactacccaacccccatgttcttttctcagagttcatggaattgaataatttggatggatattctaatttttaaaatttcttttttccatttattttaattctgcattctggggggtttcctaacctttatttttcagcctgtctattggctctaaatttggctaccattcatttaattgctaaggtctcttgtcctgtttcttcctttttttaaaaaaaaaatctcctaaatttctgaatgcaaaacattactatattttgaggctattccgaagaaacagattttgttctttttgaattctttttctctctgcattgtctctattttgtaattttaaatgtttattcatttagtctctgtctttatgaaacaacattcctcaaaggtctggtggtatctgtctgcctcagtagaataataaaagctgaatagaattttgggggctgagagtagagcttgtccactagcaggtgttactgtgattaagcagcgagtcagcttttaaactgaggactctcctatttgatggacttttctctggagccccctcattttcccagggcggaatccctccacctcttgcccagggaacatagctgggctgctgctgctctaggacacgggtcgggaggaggaggctgggaagggtgtctcgctcttccatgcaagcacttgcacactgtcccatcttcaactcagagcctcctcccattccccgctgggactggagtctctgagacctgaataccttaggttcagttcctccagagaatcaacctcccatctcgtgtgttactggaggagggtttttgcccaggtgcctgggctgagggaagggatcagaatacgccttattcagactttcaaccttcctgcatattcacttgctcacctggtttctgcccttccccgcacccgggccctcccatccccgagcccctgctccgtggttcctggcacctctcttggcctcttcttggcgttcatcctcgccaggtacttcggttcctgtttcttcagttccaccaaaccagccagtgttctcccacccatggtctgtctttgattacaggtgttgaaatgttaggtctgatctgctgttctctcttctcactcctcttcctgtggatttttaccttttttttcatttagtgttattttggtggattttcagcagtaaagaggaaataaatacatattaaatccagaagaatccagaatgtttaaatggaagtctttgatcctgtctgcttttattcagatcaaatggatcagatgacttaaatcaaaaggtaatatttatgagacacaaagaattactctctcctctcaacaaaaataaagcctccgcctctaacatcatccagtctgcctcccagacatgaacttgcgcacaaagatgtcagggagccatcaggcacggcactgcctaaaaagcccatgtggcataaagaatgagcaaagcgctacaaatacagggtccttctatacaggttattcacactgatcttcccaacagcactattagttggtaatatgtctatattgcagattaaaaaacatcagatggccagtcgcagtgtctcacacctgtaatcccagcactttggaaggccaaggcaggaagatttcttcagcccaggagttccagcccagcctgggcaacatagggagatctcgtctctaccaaaaatcagaaagttagctgggtatggtggcacatgcctttagtacccccctacttgggaggctgaggtggaggatcccttgatcccagcagggtcaaggcggcagtgagccctgatcataccactgcactccagcctggccaacagagcaagatcctgtctcaaaaataaaaataaaaataaaataaaatacatcagacatagagcggttaattggctacccaatccagaacaccaagtagcaaagacaggacttgaacccgggacctccaggtgtttctgggtgttctttgagttcctccatcctgaatcaatagtcaagcatcatgtataaatggagccacagtcctcaaggataaacactaactgcttgtaggccactgcaggccattcagtacagtgttttattgtgctgcaaagtcacctgtttccacaagtgcttccccaatgcaggctttctaaagtcatcatggaaagtaaattattttcccctaacaaactatgctaaaatgggcaggatgagcaggaagtgcttgtgtggtctacattgtatacaactatcacggaaagttcaactcatgggacacttgggttatctggaggacacatggccgtgagaggatgtggcgcttagaagctcccttcatcacttggttggccctcattcatgcatgctgaggagggggtgggaaaagttatagaagccagtagccaaacccggtatacccaaatgtttagcttagattgaagctttggtgtttctaatatgtacattcggctcacttccagaagacagagatgggggacttgaaaactagcttagcagagagttagttaatcctaaacctacctcgttctgtcaccttggcgatgaaatgactatcctaatacagtcagaagaggacttaataatcagccaggcaggtgcggggagggaatgccagaaacatgcaaaaccgccgacagcaagaagtttccattcttttgggggtgactgtgcataattaagtgcctacaattcccaaattaaaaataccagttcctttacaaccagcagtggcaggtctactcaggggcagtcaggaggctcccacaagtgcagctgtccagcactgcaccacacctttctcttttctccaaaagaaatagttttatataatagatatatccaaaaatgtagaggtcataaaaacaacagcagataaagctgtatccttgttggttttatttgtttgcttttggtgttatgtttagggtaacatgattgctgctgataagaacacattacctttgtaaacccagcactttgggaggctgaggcaggtggatcacgtgaggtcaggagtttgagaccagcctggccaacatggtgaaaccctgtctctactaaaaatacaaaaattagctgggcatggtggctcatgcctgtaatcccagctacttgggaggctgaggtgggagaatcgcttgaacccaggaggcagaggttgcagtgagccgagatcataccatcgcaccccagcctgggtgacaagagtgaaactccatctcaaaaacaaaacaaaacaaaaaaacacctgtgtagagcaagttcaccttttcatagcacatgcagaaagcacacctctgtgagtttgcaaagagaacagccctcttctgctgtgtgacatttcagaagatggaggctcagaagcttcaagtcttattttgctaccaggacagaaacagaagccaaatctttaggcttcagatttacctttttttcctaagagtgggacatcatatttaattttccaggtcaaagaccagcgcttgagttgatcatagatcttctcagagaagtcatctgaaagggaagtagtctgttttcttagtcacctgaaaagccatagaataagataaggcttagaataagaaaatattggtttctccatgagaagaaggaagagaaaaccaagttgaaccatttaagtctcagttgagttgaaatactcaagtgacaaaataatctgaaaattaaaagtatggtgtatctctaaacaattattttagcaaacatactctggttaaaaatgtattctaaagaaggttttatttaattataaatatctatattttgtttttcacctcttccaaaagggtagaataaagtaggaaaatgcacttgggttcatctcgaaactcagaggcagcgtggtgtggggcagagggctagcatgggaggtgggaggcctggtgttggcccgggaacccgcactgaccagcctgtggccagggcctcatctgagtggagggaggccttggtctagaactgagattcaccatacaagctccccagtctgcttgtggaccaggagtgtcttgggaatgggaaccaaactaatccaaagatgaagttcaactctttggttcttatgaagtgaataacccacaatgccatagacattcatttttctatacacttaagggttacaaaaggagttattaaatgtgaataacgtcttgaatatataaaattagactgcagctacagatttcccaggatccattccatattccctggaatccagcttgctccaagagcctggcacactctggagcttttgcttcacccagcaggtacggagtcaaactcgacacctggaatctgtatgttgctagtgttgagtggaactcaacacctggaatctgcattgctaacattgagtggaatttaacacctggaatctgtgtgttgctagtgttgagtggaactcaacacctgggatctgcattgctaacactgagtggaatttaacacctggaatctgtgcattgctagcattgagtcaaacttgacacctggaatctgatcattgctggtgttgagtggaactctgcacctggagtctgactagcattgagtggaacttgctagtgttgtgtggaacttgacacccagaatgcatgcattgctagtgctgtaaggaacttgacacccagaatgtatgccttgctagcattgagtggaacttaacaccagaatctgtgcatcgctagggtcgagtggaagtctacacttggaatctgcattgctagcattgagtcaaacttgacacctggaatctgatcattgctagtgttgagtggaactctatacctggagtctgactagtgttgaatggaacttgctagtgttgtatggaacttgacacccagaatttatgcgttgctagtgttgagtggaactctacacctggagtctgactagcgttgagtggaacttgctagtgttgaatggaacttgacatccagaatttatgcgttgctagtgttgagtagaactcaacacccagactctgtgtgttgctagtgttgagtcgagctggacacctggaatctgtgcgttgctcatgtttggggtttgtacttcagttattttacttgctcatggctttttgttgtaattgttttttgtttcttttttatttaaaaatcatcctttaattatctttagtatcttcagtttcattcactggcttaaccagatagtcgacaattatgtgttagacatatctgttctgaaaaatatttttagccctcaaattttttcaaaactaatttgcaagatgtatacgcactgtagttcaaatgtaaatcatcagtgtcctgattactgaggcagatgtatcaataagatcgccagatttgctagtgcaatgatgcttccttatacagcaaattatttttcctatggggatggtggggagatggatttggaggtgatttatcctgtaagagcaggtttggaaagttaattagcctctggagaaggttccaggatctctggggctgggtggagctataggggtgggaagcacctgggccactactgtgcaggtgtgtgcagtgaggatggctccctgtgcttggcccctctcactacagggcacgccttcttcctgccagctgtcctcagagacaagagtctcactcagcttcagctcaggcccgctctctactgagccttccacctggacttccaagtggaaacaccccaaagatcctcatccctttcctccactcgatgcctggtttggctaccacccataagtgtggtgttctgcctggccccgccaaacctcttccaggcacccaaggtctggcctctgctcaggttcaggtcttgggccatcgtgtattttccttctcagaataggtgcctgggttgttctgactatggtctaagagtcttccctgccctgccctgccctgccctgacctgctgtcccctccccttccctcccctcccctcccctcgcctccttctctttccctctctcccccgctccttccctccttcctccaggaattaagacattgaacattctgtctcatttccatgatttttcaaacagtgccaaaagagccagcaaatgactgtgcgattatctccaccaacctatttaaaacattgtcgttgtgtttgacttgatgtggtccttcatcttgaccatgatgtttgttttactgcttccttgatgtataatttacataccataaaatctacccttttaaagggtatgattagatggtttttagtattttcagagaattgtggaaccatcacccccagtctaattttagaatattttcatcatccaaaatagaaatccaatatccattagcagtcacttcccattcatccttcccctagccttcagcagcctctactctgctttctgtctctgtggatttgcctactctggccgtgtcatataaatggagtcatttggacttttgtgaatggcttctttcatggaggatactgttttcaagattcatctgtgttacagaatgtatctaaactccattcctttttatggccaataatattccactgtatgcacctgtcacactgttcatccatccatcagttgctggacacttcctggctggttttcactattcagctggtatgaatgaggctgctatgaactgttatgctcaagtttttatgtggatataactgttagatttataatcattctaattagccattttgtacttttttttaaagttttttttcttttattatactttaagttttagggtacatgtgcacattgtgcaggttagttacatatgtatacatgtgccatgctggtgcgctgcacccactaactcgtcatctagcattaggtatatctcccaatactatccctcccccctccccccaacccacaacagtccccagagtgtgatgttccccttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatcattttttatgaccgcatagtattccatggtgtatatgtgccacattttcttaatccagtctatcattgttggacatttgggttggttccaagtctttgctattgtgaataatgcctcaataaacatacgtgtgcatgtgtctttatagcagcatgatttatagtcctttgggtatatacctagtaatgggatggctgggtcaaatggtatttctagttctagatccctgaggaatcgccacactgacttccacaatggttgaactagtttacagtcccaccaacagtgtaaaagtgttcctatttctccacatcctctccatcacctgttgtttcctgactttttaatgactgccattctaactgatgtgagatggtatctcattgtggttttgatttgcatttctctgatggccagtgatgatgagcattttttcatgtgatttttggctgcataaatgtcttcttttgagaagtatctgttcatgtcctttgcctgaaactgggtattttattcctcagaaagaaagaggagactcgaacttctaaacataaattgtgtttgaaaatattggagcttacttatcctaccataaaacactcagtttaaaatgagcagttttaagatacttggttttgttccaactaatacctctcctgcctttttttggtcaatttatttttgttattaaaatttcttctgccgttggcacccccagaacaatatattcttcaatagtttaaaggagctgcttcctcactgggatgtggacccttcttccttcttttaattacagcgttattaaactcctccaggttgacactttctttcattctctattttagatttgtcaatcagaggtgctccatgaagcagctccttagtgctgggggaaatgcaaagccatggcgtgtcactgtgggtgcaaacctgcttctggagctgtgacgttcttggggagggagggctgtgaagggtcatcttggaggggccacccctgcatctcacccgtgagccatccttctcagaggatgagagagtggataagagctcaggagctgcaagggagcattgcgggagcactgtgcatcataagaggggaggatgaaaccgacaaagacgggcacctggcagggagtgctagtaaactgaggcgtggactacagaaacaatcctcccccgaagaacttttgaaaatattgtacagacccagggcaccctccctgacctacagaagccaaaaccccagtgtgggagcacagtatgtacgtttagaaaagttttcatatggccgggctcagtggctcatgctgtaatcccggcaatttgggaggctgaggcaggtggatcacctgaggtcaggagttcaagaccagcctggccaacatggcgaaaccctgtctctactaaaaatacaaaaattagccaggcatggtggctggtgcctgtaatcccagctacttgggaggctgaggcagaagaattgtttgaacccaggaggcggaggttgcagtgagctgagattgcatcactacactctagcctgagcgacagagtgagattccatcttaaaaaaataaaaaggcagaggttgcagtgaaccgagatcacaccactgcactccagcctgggtgactgtctcaaaaaacaaaacaaaacaatacaaaaattgtaagtatgtgtggggctcatgtgctgagtttggtgggggaaatctttccatgcacccccacaactgtctacaatatgaaaacaatcttcaagaaaacaccagcgaacagaccattcgtctttccctgttgccacattttatcttggtctcaggctgctgacctgtcagatgattgacaaatggaaaccgtatggtggctcagagggaccaggcgtggtgtgtgctgcattgaggagagggtgggtaggcaaatagaagttaagcaccctaacagaaatcattctaggcttcagagcttagccagtagcttagcaagtggtattttctaggaagccactcagattagtgccaaccttctgcagaaatacagagctataggtgctgggtgagttgtgagcaaagccatgttcagaatatgttaagtttctattttttaagtgagcttatttgctgaggtaatgcagtttgcctgaggcaaatgatcatttagatcagctttcatcttttaagccagatcttgagatttgaggcgctaaactctttgcgtacgcattttacagctctcttacttggttgggatccactgcttcccagtatctgcagacccttctggggactgtgacctgcagggggttaggtagctgttttcaggggggcattttgagcccgacattcacgttttataacattagctgtgtgggggctggcaagaagaatctagccttttccattaatttagtgactttgttcattttaattttttagttaattcactgactttataattttgctaaaccctacaaactgctcagcataaatgatttcctttaatccctacaaaatgtcaggctcccaggcctgcaggctcagagtgtatgcagggcgaatgctgcttgtgtcttatccaggacagactggcctgtctcgcacctgtcaggcaactttactcctgatgctgctttctgggacgccatccaatctcatttggaggttttgtcagtgagcagatctgtttctgttagattcaattgaggcagaggcagacactgaggacagatgggtggctgaagataacaccggggaaaccagcctctaagaaatagagccactgcaattaagacttccactctctctccagaggttgtggagtcaacagaaaagcagatccatgtctgaagaccatgacaccttagaagcccagacagacgagagggaaaacagcctagaagaccttgccttattatttctactctagaaagatgcacgggatcaataaagtaaatgagctgtttcatccaagctggccgcgcagatccagggccacagagacagacagacacataaacgcattgatcaccctgctagggcctactggcctaccctgcatggaaaatgtgaatggaaagaaggcaaggaaaatacactatttgtagttctgagccacagctctgattgtaggtcacctcctttcctctgtggaagggcagtcacattgtgatctttcaaaacattggctaaggcggtgatgataaccaaggctgatatgttaccagcacacagcagatctcagggctgagagtgaggcatgaatcttccaagtaagtggctccatatgggcctctttgaggtctttaaagtcaacagtctcttcatcatggaattcaacttgacccctgttccaccgacatcagaactggtgaggtgacagggatttagagcgacttgtcaaagggatgggaaatgcatttgctcaaatgataatgacattcacaatagtcaagattcgttgagctaggatgcatgctaagaactttacaagcatttctattaaaatctcaacactgctcaatgaaatatgtattatcgtctccatttttagataagagaattaatgtttagaaaggcaagttgatcaggcatatctgtgcagcaaatggtaagactcgacttgaactaaccttagacaaaaaaacaaaaaacaaagcaaagctgtggagtggcaagagcaaggctggccttagggacagcgggatgggggctcaggtgcagctgagaccctacccataccccttctgattgcgctgctggcttctccacttagggaatgagaggagacaatcagttgctattctgagtcatttcctgggtctctgagtaaaaaggagagaagcttcctctcttccagcttcagtttgaagagtctcaggcaagaacccggttggcctggtagagtcttatgcccatccttgaagcaatccctgaagctggaggatacagtcctaagggtcctaagttactgggtgccatatggtggtgggcggggtggggtccatcaccaaaatggagcacagagggagctagtatgaatcaggcaagcagttggctccacttccacatgagatggcagcaggcatcgctaagcctgattcacagcacctgggcttaagttgcagcaccgatacataccagctatgggactttagagagggcattttctctgtgtcttgatttccttcattttaaactgaggacaatcatatctaactcctgtgataattgggtgtgttaaatgaattaatgcattagaggagtatctaatacaaggtagatgcttcattaatgtaagctaatgttatttttaccattacttttactgttattataaggagctatgtatcttgtccaaggtcctgtaatagctaataagtaaaagagccaaaattattattattatttgagatggagtctcactctgtcacccaggctggagtacagtggcgagatcttggctcaccccaacctctgcctcccgggttcaagtgattttcctgcctcagcctcccaagtagctgagactataggcacgcgctatcatgcctggctaattttttagtagagatagggtttcaccatgttggccaggctggtcttgaactcgtgacctcaggtgatccacccacctcggcctcccaaagtgctgggattacaggcatgagccactgcgcttggccccaaaattcttatcagagttacagtgggagatatcacaccatgagctctccttctaaggatgcccaggccctgaattctggcacctacctcgcctgcattttgtaggttgcactgatttgcttagtggggccacagtcaacaggctctgatcaaagccacccttgccgcagctgacccagcagcctgcccagctccatccagggctgttagcccatcctaaaaaggccctctccttatagaccattgcccgaggaggtctttccaggccctacctcctgaaactcctctctggcctagtctaatatcccttatccttcctaactttcctaagtttccagtcctaacttccctctccacctgcaccttggacatgatgattgacactgtgacttgcttctcaaaatcagctcccctatcaggtctgttttgttctccgtcctgaagacagtggtcacgacctcgcccaaccctgggctggggctcagcctcctgctcattacaggggcagacgtgccctttgatgtcaggcctgaatagaggttccttatttattacaatttattatcctccgaatctgcctggggttttgatagaacctggctgccaacggcttgccctggcctttctgaaacctcaccatttccacaatgaaacaggacgcaaggactgtgcccctggtatgggaagggaaggaggagaagcttgcgtttacaagtgagatatccacagacagggaacatactacatttttttcttctagactagcctctgtggactagttcatcctccataaggttgatatttttttcccaaagcctggatttgcattgcctagagccacattcacggtaggagatgggtcttcccagtgtgactggactcacttcttagcactccctcggtgggtgagttaggctggaatgaagggaggagccacctttgggattgcggtgctgccctgggcacctcacactgccttctcttcctgctgctcgctggtgcatgcttagaaaacccagtcagcttgttttgacctaaagcaaaaaccattattctctgagtttgtaggtaagcttccacccaaaatattgttgtgagaccttggatttggtgatcttgggctagctgcctaacttctttgggcttccatttctgctctatcaggtaaaggattgggacagatgatcttttatggctataaacatccagtgtgctccaaggccactgccaaatatacgcttcaacaacgctaggagtggtttgcatgatctcctaggcttgggaactctgggagcagggattgtctgttctgtgcctggtacatgggggtcatttaatacacgtctcgacaactgcatagcccttttgctccctgagctgagaggacagaggaggatgttaacagtcactgtctcaaaaagccctgagcaaatctgctctgttctcagcacctctcagcactgcctccttcatgagtccctgctgggtgggtagggggctaattaagcttgagtttcaagaacttgtctacaaatccacttcaagggctcacatgcaaatcaggccctgctggcagccattaccatctcccacctgcagcccaggccttagaggccaggattcacaagcagaacaacacctgccctcctctgagagctgtgctgcagcccagggccacgtggacagggtgctggtgcattctccagcaacactgttgagctctctagtttgcagaagagtccaagggtcctcacaaaacctgtgacaactgaacaatcccaccattcttatatgatatatataaccaccattccatatgtataattatgattgaaaccgaatatcattcctgattgcagagtctccaagatggtaatttctgtcttagtgtattttccactggtagttttgtttgttttcctgactaacgttatgaaacagtattactctcctgttacagatgtacacactgggatgcagagaggtgatctgacacaaggacagcccatggtcaagcccctttgacttctgtctgctgttgaaaaggatgtgcctccctttcactgagcctcattgcaatacttgtatagattctgtgcccctccctcccttccttccttcttccctgcctgcctgcctgccacaggtgtttaatgaacatcaactatgtgccaggggctgtggagtattctagaaatgaaacaaggttcctgctctgagtttttatgttgacgagaaggaaagggtgaataaacaaatacattaacaagaaaatatcaaggagcgataagagccctgataattatttaagatgagactcaggaggcaaatgtgacttgagcagcctgccccgcctcctgtgtgaagaaaggcaggaaaacattccagcaagagagaatccccactgttagaatctctgcatgttgtcattagctgcatagatctgcttgttgaaacatgaaccaaaactttcaatcttggtctgcttgccctggataaagtgcatttctgagtcttggaccacagcttgggaaattagcagaggcaaatgcaattgtctcttctaaagtctttttttttctttttttttttttttgagacagggtcttgctgtgacccaggatggactgcagtggtgccatcacagctcactgcaacctccgcctcctgggggcaagtgatcctcccacttcagcctcccgagtagctgggactacaggtgcccaccatacgcttggctaaattttgtatttttttgtagaaagggggttttgccatgttggccaggctggtcttgaacttgtgagttcaagccatccaactgcctcagcctcccaaattgctgggattacaagtatgagccactgcgcctggccctctcccagtcttgagaccacagtggttggaagctttaacagaaaacattatatgtgtgtcttcctcaggaaatgtattttgttaaaaatctgtaacatgaagggaatggtaggaaagagtaggctgcttttgcatttaaaacaatgttaggagtgaatcgctttcctggtgggttatgttagaatgaatctcaaaccctcactaatatctttcagaggaattttggcaaatagcagttgtttcttggcctaattgaagtcttggttaatttatcccaataacaataacattaccagtatttgtataacaaaaatggtttctgactgtgccagcgtgggacgaatgagactcatcacaatttgttttagggatggagatttagaagaatgggtggagaacattctaaatggaatctatggacagggtttttattcttagtgaattttgaagaagtgacgtaaaggaaacagtttcgtgtaagccctggctcctccctcaggggcagctggacaagtcgagcagatcctggaagtaaaaggcagccccggatttttatttctgttttccctttcaccctaacaaggccgtgctctcctgctcatctctctccactgcctggactcctctctctctgccttctctctctgtttcctcccccttctctgtgtgcttccacctcccgctgctccctgctctccctgtctccgttccccatcccttcttgctctttgctgctgaccagctgtgcaactctgtgcatctgagggactcctctggacgtcagctgccacatctgtgttattgaaggggacagacacgggattcctattatggccaacgcagactcaccctttctgcaggctcaccaaggaacgaccactcagggagagtgggtctgacatcctgagaatcaccatgacttccccaaaccagtgggacatccggggcctttgactgtggctgggctgcctctgacgggcgggaccctgacacccaccttagctgtgacagttgctccatgcagctagttcctgggcacctgtgcagttccttccacaggaggacattctgccctttgccttctttgagacatgggtgtcttgcttaaggggaccagtttcccccacgtgcctctctaccatcctttggctatagggtattttaaacatacagatttattttccttttctatttacagtttcctttgggtgagaacggagtgagttggttatgaccgggggacctgagtcacaccactttgattaatgccagctccaccacgcactagctgcatgactttggacaaatttcttactttcttgcagttctgtttacccattggaaaactgaaataataaaaagaacaaccttacgtggttggggagaagtagatacacggattcattacagtgcatggcacattttatttttatcttggttaaaaaatgcatagcatagaatttaccatgttaactgttttcaaatgttcagttcagtagtgtgaagtagatccacacagctggaaaccagatctccagtgcacggcacatttttatgctggaaatacctctgttagaaataaatccttggaattgatacatacacaaagccgtcactcatcacaaatgatggaactagaaagccaaggcctattggtgtctaagagtcagcctgcccatgctcacagacctgcctggaaaggttttgttttgtttagaattttctttttatcaccatttcttcattactggaagcctggctctttgcagacaaatcgatatctccaaggttaaacaatttatttttgtatatttttcaggagacatcgagtccctgtaatgcaagcaagttgctcatttcctgcttctccagttctgtcttccttgtcccctcttcccctgcctctctcctctcttctcttaccctctttgttatctcatcataatttcttcacagcccaatttctttctttctttctttttttttttgttttgagatggagtctcactctgtcacccaggctggagtacagtggcatgatctcggatcactgcaacctccgcctcccaggttcaagcaattctgcctcagcctcccgagtagctgggattgcaggcccctgcaacacgcgccccccacccctgtctaatttttgtatttttatttatttttaatattatattctatggagtcatttcccaactagcatgtcttatgcttgaattattctttatacttaatactgcccatcacataaaagacgttgtcacgaacccagtgttgttggcagaattttggctcctatgatctctgtcacctggtgtcacaccaatgggtatattacagtacctggcaaaagagactttgcagatggaattaaggttggaaatcgtcttggattctctaggtgggaccagtgtcatgatatgagcccttcaaagcaacagacgaggtcaaagcaagggaaggactcagtgtgcaactggtggcttaagggaggagaaggcctgagaaggggctggaccctggcaccagcatgagctcggaagcaggttttccccccaccccacccccagagcctccaggaagaagtgcagcactgctgaaactttgatctgcaccgccccactcccaggccctggacagaaaatacagccactctatgctggacctgggacctatagaactatagtgggtgttgccttaagatgctcagcttgcagcaatttgttttggccgcaacagagcactcctacacctaccattcactggcagataagagcttagaagcaaggctatttattcttactggagactggcttttttttttttttttgaggcggagtctcggtctgtcgcccaggctggagtgcagtggcacgatctcggctcactacaacctcagcctccagggtagctgggattacaggtgtccatcaccacacctgtctaacttttgtatttttagtagagacggagtttcgtcatcttggccaggctggtctcaaactcctgacctcaagtgacccacccacctcggcctcccaaagttctgggattacaggcatgagccaccatgcccagccagaggctggcttttttttgcttcaaatgctttatgaccaaaactgtctatgtgcagggtccccagctgaagtggatacatattttgtgttcatggaataggaggaaattagttggcctttcagaaatatgggacaagatttcttcttagaaatgtgccctaagcaagtgaattgagtaaaagtgtggattctgagtccctgctccttgcagaggactatctggaaatcggttgcattctcaggaaaataattcagaagtgcagtatcctgtggaccactgcatatttcctgaatcagtatctttgtggatatgggaaggggatgtatgtatatgtttggtgagcgcccaggcagtacatacaaacatttgaaacccactgctgtgctccagtgttttttaaacagctggttgagacccattgaatcatgaaatcagtgtagccagaccatcgtttaaaaaaattagaagtgcataggaaagaaaaggtaatgttatcagaatgtcttgcaacatggtaaggacaagtgtgtttggtgaaacttttgtttcaatgtgtgtgttttcactatatgtgtctgcgtatgtgtgtgtccagagtcaccatgtaaaatgagcaggaatatttcagaagcactgctcttgtctgatcttgcaaatctcaagcctttgtcctggactctccaatgcgctgggtctctgatcaaccctgccctgaccacctgcgtggcctgccttgccttatggcgaccctcggaagagtcgagcaggcagcgcgtgcctggggctttcagggacacacttccttccattcggggacctgtgagtatgtcagtggaaatcatttttttttctttttctttttttattttttgagacagggcctcagtctgtcgcccaggttacagtgtgatcctggctcactgcagtcttcatcttctgggctcaagccatcttcccacctcagcctcccaagtagctaggattacaggcacacaccaccacacctggctaacttttgtattttttgtagagatggagtctcgtcatgttgcccaggctggtcttgaactcctgggctcaagcgattctcccaactctcccttccaaagtgctgggtttacaggcatgagtcactgcacccagccaaaataattttctattcgctggggagtaaagttgtctttgcatctcccgcacagatatacacaagaaatataggcaggtgctggctacggatgcatagaaatggatggcttcaatacaaggtttttggttgatgtggaacaatattaccgcatagataaagaagccccttcaaaattagctttaccaatgagatatggtaaaaaaaagaagtataagtgatgaaaactaaagagacatatgactgtaagtgttaagacttgaaggaaataataaaagccaaactgcatctctgattttaaaatatgggagtcataataaatcaacagaaaggataaaggtatgctgaggaaagccaaagaggagtgaccactgttggtcaccaaactgctggctatttgcagaagggcctgaggccctgacctgagacttgtgctcaagtcagcatagtttgggctcattggaatatgtgatgctaacgatgtcccccagaagagtattttgttcctttacgcactttttaaaataatcatctgtgatatgaaaatttggactggtcttgaaggaatgagtcctctccttacccaggtttctttgtgatgtcaggcaatgatggtaataagaatggtactccagtactaggagtaatacggtactttgatagcgcactaatgcacagcattggcagaaggctcatggtggatgtgaaattaaacgcttcgtataacccataggcgatgttgttgtctttgtcatggacaggggagaaacatgaggcccagagaggtaaggtgagcactccctaatagtcagcattgggtgaggcaggaacattgtggccctgagtccctgagattcagggcttttcccatgaagccaacccactggtcactgagtggtttcactcctttcaccaaccaggatacttcagaaagcacttggggtgacccaaagctgggtccagatcaggggagtcggttgtaagttgtcatgacacttcatccttacagaaggtggaagttactcatttctgttcaatgagctttgaagaacaaaaggtcactgctaatttgaagattaaacctttataccaacaacatcctccaattactatagaaaatttagcatccaccatttgctcaggaagcaaagaagtcactgttgaacaaactctgaaataaccaaggcctccaggccccacacctcttttaaagtgctttcatgctgaccatctttttttttttttccttctatcttcagcccctaaccacaaagccaaaaaccacaagaaggcagaaaagtacaataaatgggttttctctacccatccccagcaattgtttcacagttttattaagttggggattcttggaaaaaaaaatcctgaaaaaaaaaaaacaattctagtttaggatccctctttgagtgctctgcaacataggcgagagcagtaaaaacacgttccattgaacacagagcctcagacatagacatctgtctgttggaaggaagtcactgactatggctttatgctgaaatacacagatcacgtttatataggattttatcatttgaaaacatccctgctcagagatgatcctgcctcattctgcaacagccttttgcagtttacatggaaggattcagattaggagggagaagttgaagagcctttagactagaggcagcaggaggaggaacagcctcagatgggggagagaggagaagttggcatgtccaccactagcaaagatctgggtgctgcttcaagatagaacccaagggaagtggcagggtcccaaggggaatgttgagtgaggctctcactgggggaggtcccagattcctggcccccagcccctccaaagggttatgagtcccaggatggcccagaagcaacagggctgacacaccttaaggagcaatgcaggctgaagaagttcctgccactggtgactcatcatcagaattcccctttccctgggctgtggctctgcataaactcacaggactgcagaccaggcctggaggagatgaccccagagaggaggaagactgagtgtgctgccagcctattagaactcagcattgcattcaaattctagttgctctaaagaaaattaggaaatgtgatatttcttgcacacctgaatttgtaggctacatgcagaacaaaggacaaaatgagagtccaagaaggaagtgcagtgctttaagggttgagtgaatggagactgaagggtatttaacgggccattggcatcaaattagaaagtatgggtcttagaatttcttttacattagaagactttgggctgaatattgatattctagggataaattcttgataccctaaaattcagccctcatacaaagcagtgattgtgatttcatgaatgttgtccctgagaaacaagtgtctggcatgagctccccatgtctggaccaccaagctgataccaataatggctgttgcttccttttcccctacatcaaaaccttaggtttgcttcaggcttatggccttggtcatcctaggagtcaccaacttgctatgagaagctggcctgattttgtgtcactttcatctttgtaaagtataaacacaacatgtgaagttgttaattttcagtgcactgccccattctgtagcgttctactttgtaaatgacattgagcatatacactttccaccattgtagtaagcccaacattcagtgaagacagatgcctccatttatttaaaaaaaatcaacacattattaattttaatgcaatttaagctaaaaatgaccgacaattcttggtttaccaacaacctcttttaaaaattgagactctcataagaggatttcggtttaaaaatgttgaaaggtctttttgtatagaaacagaatgaagtacaggatatatttaaaatgtggctaattaacaaaatatttgtggtggctcatgcctgtgatctaagcactttgagaagctgaggcaagtggatcacctgaagccaggagttcaagaccagcctggcaaacatggtgaaacctcgtctctactaaaaacacaaaaattagccaggcatggtagtgcgcacctataatctcagctactcgggaggctgaggcataagaatcgcatgaacccgggaggtggaggctgcagtgagctgagattgcaccactgcactccagcctgggcaacaacccgggagacagatagatagatagatagattctctctctcaaaatatatatataaatatatatatatgtataaatatatatatctatatataatatataatatatatacacatttatatattatatatagatatatatttatataatgttatataaatagatatagatatataaataaatatatataaatatatagagagtatatatatgtttacgtatatatttagagagaatatatatatatattcgagtttatattattatttttaagatttcaaaagccttcccttaaacacttagatccatgaatatcccgtttttttactaatgtgggcgatgaaacttcaaatgacttgggaaaagatattctaggaatgacaatctttttttaaaaaaattcttgctaggaagaagtatcagaaacctccatgttcttacccatattttcagtgattaacagtttcttgtgatgcaagttttctccacagtttgtttccagggttacaaatccatcatgcctaccttttcaaaatcacattaattcaagttcacattatttttatcagccatcaattaaatattaatcagcttttcttggtctttagcctataggtcttacttacaagactctttaaagaggaaatactagaaaccctgccagttcaatcccctggcttggaataattttgtcagcagtactgactcctgtagctatctgtgttgcttaacttgcgacttctcttaagtggaaagttgaagagctttaagagtattaacttgctttgtttccatattgacatgatcaacaggctacccacagatctgatgcatttcaatgcccaaacacaagagcatgcccctggaaaactgctgattctgagttccagtaaagctttaagctcctgagattatgaccatttctttattttggttttccactcgtagaaactgtctttcagataagagaggaacactactgtccagagagtggtgacaaggcatcatgggagaggtgcttaaaagtctccccaaccgccccatcatacttccttgcaagagccagctctggtgtcagaaattccctagtgttctgctggtttatgtaagacatgaccctctccaatgtgaatgcctctgtagagagagccaactgatgacggccttaaataaagatcctgaaactcctgtcctcttcattcagccagagaggagctgagctcacagccctaaactattcatttctaccaatggcagaaagtgtatagcccatttttatatgtttaatatgtaaggcagcataatattagtttatacacactcatttggaccccttatctctctgtgtgtgtttaatttgtttcttttgccattttaaaaacacttgaggtgtggtgcactcatgaaaatgcatctccctctttttttttttttttttttgagacaaagtctctgtcacccaggctggagtggttcagtggtgcaatcttggctcactgaaacctccgcctccctgttcaagtgattctcctgcctcagcctcatgagtagctgggattacaagcatgtgccaccacacccagctaatttttttatttttagtagagacggggtttggtttcaccatgttgatcaggctggtctcgaactcctgacctcatgatctgcctgctttggcatcccaaagtgctgagattacaggtgtgtgccaccgtgcctggccgaaaatgcatctcttaatggtcttgaggactgagccccatggctggcagtctgggctgtggatgtgtgatcctgcttgggtttaggaggatgaacaagctgaacttctcacttaggaaattgcaaaataccattgcacactgaaacctgtaaatttattttggaataattatggattgctaagggggacagaaattaaggccataactctacaaattgtaaccaccaggattgcctaggtaacagctccaagatctccagggctccaagaagaagcgtttatttctcagtcttgccacatgcccattgctgacctaccagggggctctgctgtccccctcctcatgctggttgccatgccagaggaaagagagctctggaaggttttatgtcggggctgttcaagctgctcatgccaaagggatgctgcttccttctagaacctgttgacaggtcacccagttccttctggccatagcaaccaggaaggataatgtaacatgtgcccgggggaggtgggctggaaatgtttggcagccagcactgctcacacacagatgtcaagagatgattttcactggacagaaaagccagcagcctttccggaggtgaagtatcctccgtcttcatgactaggaagaggctttgtgctgtgtctctcggtgtgctattaatatgtgagccagtgcattgccctaaccatcaactccatcctgcttcctcatcaagagaaaaatgcaaaaccacctgctgtgggatggagaagaccagcgcattcccgaggaggcactgctttcccttgccctcacagcctggcctttgaatattctcccagaaataggttcttggttctcattctcctttcctgagccctcctttctcacttctcttcccactctgtgccctggagtgccttcctgtaattcagagctggtgttcttttgggggatttctcttcatgattgagatgagactgtctaaggggctaatgtcacccatttcagaattcacttcccggataaggattcttcatagctgtgttaagattttgctgttgttgagtccccagctggctagtgctcttggcctccatcacttttctcttcctcctttcttgccccctttggtttcatgaagctgattttttctcaagtttcgactcttgcctctgagccaccttttcagtgcatgactttcactgccctaaaataacctatagcaagaaaatcccaaaagaacagtgttcattcactgcttctaagtgacaatcagaacttcttttaaagacagcatattattataattcattacaatgaaaaacagaaggtgcctgggtgagttgaagtaattgtttagttgtggctcctgatctttttaaaaggtctgcatgtgaactaaacactctaaatatgtccagtccctcctgtcaaattcctgtaagggcagaatcacctcggggagtggttcttccggagtggtgattgacatgcaaaatgctgcgcagagagcctcagcattcactagggcgtcttccttcctcccctcctcctttccttcctccatgactgaaggcttgcgtggttcccacaccctgctgggcactgatcaggttctaagatctgccttcaaggaacccacagcctcatggagagaacgacggacaattaggtcaccacaacaccggatagaaaccccacaggcgcagtcagtgcctgcctggctcacactttcataccctagagccaggactccaaaaccatgtgtccaatgaatcactcagcaccgggactgtcacaaaagtgagtgtaaagaactgtgggtcattccctctgcatcgtgcatttctctgacaggggccctgcactatttgcggaggcatctgtagatttatttcttaattgcctaaaccactctgaaatacctgtccattcccttagcataagattaagtggataatggccaaatctctatttttctgagtagccaaacttagcggtcagcatttagcctttatccacaaacatggataggaagccctgcccctgggcatggcagacgggcaggaccaaccaagaagcagggaccagcccaggcacagtgaggaccctcagcatcaggcaatgattttgagttgagataatggttagtgtctgtgtttctcagagcaggatatgctctttaatctaggatgcaaagcccatatgaggtaagaaaaagaatgtagaaccatttggaaaacacccatttttcccctgggaggctgagtaggtcagggggatccgctggcagggggtcctctccactcccctctgattcccagaggccgagaatgtcgtgttcagccattggttactctgtgctgcacggtgaagtctgtggttgttggtaagcagcgtaaaagccagggagtgtctgctgcaagaatccctgggcatcacgttgcttccgacactggtctgtgtgagtcccacagacgtcctagcagctgcaaggggcacacacctccgacctccgaccggcaggtatgaatgcttccaaagtgcccggagtgaacagattaaagcaattttggagggtgagtaaaaggatacaaatcaacttactgaacaaaaagaaaaagtttaatttctggaaaaaaaaaaaaaagtagctgacctgcagtctgagatatgctgagagatacacacattatcttacaaaatttctgcggggaggttcagtcgtgcctgtttgatgccttactaaatgttgggaatctaattttaactgatctgcagcagaagcaatcagcagccagctctgtgttgggtgtttactcagagcaaaagttttctgggaaaggcagtttagcatctgagccacggtgcgatggttagccatatttatgaccactcatgcatcaaccagcatagtctgatcttagcctctgggagccgatttaagtcttgaatgtgatggctaatagatagaattctgaaaatatgtgtatatatgttttccttcagactctctagtctctcagaagccctatctaactagaaggacaaaagaaaatctcagtctttgcattgtactgttaaagcattagaatgtactaaggcaattgtaatcacaaagcattcaaatgtatggtatgcattgtaggctattaacataatcctgtgtaatgagaagatcagcaccaagctagcctaatggcagacagcttctgggatttcaatttttgcctggattcacagaatagtaaaacctcttgggaattcattgcttttttttcagttgtcagaagctaggctctgtgcaacaagtaaagaattctttcctgaatagttattctacttgggattcagggagatggtaaatgtccacgctgggtatcaatatcagagtccgttccatcagtgcttagggtctagaaaggaatggatgatcctgaagccgatgttcagtgatccctcacacttgtaatgcagggctggaataacgtgatgggtaggtttccatcttggttgaacattttatgattctatggttttctttcaatgctaggattgtcatcctgatcgttagaaatcactttagtagatgaataaacagcaagcagtgagcgcatctaatagatttctgacaatagatcgacagcttttctttctctctgttgctctaagtcatttgagaaaagcctggggttacagatattctttgtcaattacttctggaatccccatatctactcttttaggcttttaaagatgagataatatgagtatgctagtaattttgaaattacttcttaagcaaggttctgcattcactgggtagaaccaaaataatgcctttccaaattaaagcatgtgtatagtatataagcgggtatttcttctgagtaagcaagaagatattaaaaacattgaaatgatggaactctgcagaagaaccatatgacgcatgcacaactctaggctgcattgggaaaaccagccatatttgggtttgggattagcctcttggttttgtgcaagttgcttagtgccctgtattacccatcagtgaagtgagtggttcctcccagctctgagatttcatccgaacagcatggaaaacagtagatcattttcaccaaatatctgtgtagataggactgggaacatctgattaaatgtgttgagtgtcacattttctagatgttagaggactctgacaatgtcttgttgaaatcatacttgggtctggctctggactctaaaaagctcttccttaatgacatcagttgtgatggatcagagtcacttgtagatatggtgatgaacaaaagactagtttttattttctctttcacagatgaaaccttattttagccactgacatctccgaatgatctgaaaatgtattgcatacaacacctcaaagtttcagatggacactccctcagttgtatttggaagggaggccccaggggccccttggcatcctctgagagatgttcctgcagacgcacaatgcacacaagtgcacagaggcaactgacttggggtcccaagctagtagcacacaggcatggcctgagtactcagaggaggactccggtggatatgagcagacacccagggtttcacttgtcaccaacacagtccagatgatgaagcaaatactcaatactccaaagaattccttaattatttaggaaatttaaatgggtgatataattactcggttgtctcaattctgaattattcattctgtttttaatggtagtttgatgctagtaactccaggctattattaataattttttaaaaaatcagaagtagattagaaaacagtttcagaggaaggatttaaaagcctcttaatggaggagtggctatgcggcattgcattcaaacagccacagctgaaggctgactgggcttcctccaggctgtcctccttcctgagccagttcccgtttggagtctgggctggagggagctcctggcagtgccatgactcagtctggtgaaaaagcctgtgtgtgttcaggctgactttgaaggaagcacctctaatgatctgcagccagggtggctttgaagatggtaagcatagaatttcaagaactggactttgggtactcgtatgaaatggaacattattataccactaatttgttctctttaaaaaacagtgagagtcttctcatggttttggtagtctctatttatttatatatttttattggtagcaagtgggaataagagcacagttgtttaaacaaacccaagaccattctacttgctgtggctggaaagtgaagagtattggaatcactgttttaagtggctttgctgtttagactgaatgtgcacgagagccaaatgactatttgatttcactagaaaaatctgtaaatctggttattggatactgtataaagccatttaattccacaaatgttagcccacagaaatctgtgcactggaagagctcctttaaatttacaacagcaagaaaaataggtttgctttcctatatactctctactgttagttacaatgacatgaaacaacccaagtttgaatatttaagagtagccacaatcacgaagggcagtgtgatagaaccgagcaatgaacaggatgtaagaaatcctggtttaatcctatctttcctatggttttgcccaaagtggtcacttctcctccctaagcttcagtttttctcacctgtaaaattggggaagagggtgtagatgaaatcagcatgattctgcatgtcagtagtacattattatctcctagaaagctttaaaaaaaaaacttctgatgccgagactctaacccactctaattaagtcagagacacaatggatgaggcccgggatatcaatacatgctcaataaagctcaccaggtcattctaatgggcatctatctaaagttgagaacagtagaaccgtctgaaggtctcttctggctccaacattccgtacctgaagatgctaatggctctttctcaatgtcagagcacgatgcagatcgtcttgtggtcacggtggttctcttgactcttctggtcacgcgtaaagaccgggagtggaaggcagcacctcagcagatccaaaggccatgaacaccccacagtgacttcccaagctagagactgtgagtgtacttggtgtggacaaggcattcgggaaccactgaattaaatgggatatttttattcttaagagcagtgaactctactttcaaggggatgaaacaagtgaaaaaaatactttcccccccaaatatatttgtcttggctacaccgaggtctaatcagattttaggtatacaaagattaataagacacagtccttatcttaataagacatagtccttatcttaaattaatttacaatctagtaggggtgagggacaaattacaatctagtgggggtgagagacaaatagtaactgtgtaatgtgggggtctctaagtctgatattgcttagctatgcagttttctagtctcagaaacttggctaatgaattcaaaactggaaggaggacccctaaccctgtcatttgcccagttaaggtagttgagttttgcgagtgagcttttcattatgctttccatacatatttctttgaaacacaaaggtatctaataaacccacacaaccccacacctgtacacacacagactctggtattgcgaagtgtttacactgatgtgcaacaagcctctatgtacttaaatatgcaaacctatatttacatatttcgataaaagaacaaaatacaataggatacttcatcagtcatgacacaaaggtgaaaaccactgttaactacttgtgaacctcttattctatccttaagcatctggaggcagcttgtgtattagaattattgagcctccgtgtcccagatttgtgtcagaacctatccttatccaagacttcttccgaccagggagagaaacaatagcctgggtgtttgtgttctttgcagctctgaccaggtaagactagttgtctataggtctccttcttgcgttctgtgggtctccctgaaaccattttctgcaggttgttaggaagtagggaaggctattttaaaattgctaatccaaagaggaggtaagatgagatcgtgatacctttttccccaagggactaaccacacaaccaaccaaccaggatagtttagtagaagaagcatcaacagtgctacaaatcagaatttgaatttgtatctttccacaacctagctatgtttgcttaggcaaatttcaacctgcctgaatcagatttcctccaatttaagatgaagctggtaatacccctacgtagtgtttgggggtgaagattaaatttaatattaatactgtttatacagcagctattaaaataactagcacatagtagatgttcagttagtggtgtccaaggtggctgataactgtcatgggagactgagtgcaccacttagtaagatgtttgttccgccaactcagtctctatgaagtagctctgtgtgatgtgggagaggtcatggggttgcagtggtacatttggaaaaagaaaaaatactacctcttagactcttaatggagtaaatggtgtcattgcgtagattctcattagccagttctcccttccctctcatgccgtgtctctggggttgagaccagcgaggctatctttgtatttgaatctctctttgtggtctggcttgtgtttcagtgtatatctttccacacaaaccagatcaactgctttcagctctgggaggaaaacaaagaaacaaaatgtgatgcagtcaaacaatttaatttctcaaagctttatgattcaaataaccaacaacattttacaatgagtcattttgatggccagtaacaccacccatggcttcttctttggccttaaataccgtccttttagagaacgttcttagtttctttttaaccaacagtcaaaaattattaatttggctctttattcatgaacattaaaagctggaagttaataaatattttatgattgtaaagctccaatgcatatctgattgatatggagggataaagaattgaaggcaagagaggcctcctctttccagaatttgcaaaatcaatataacttgggctttcactgatatactaggtgcatgactaacattggctagagcaggtgctgtctgatggaatggcgctgccaggaaaccctgatgctgccccggggaggtctccaggtgagtttgatcattgcatctttccctagtcttccaggtgaggttggctagaatacccaggggaggaaaagagagcgtttatataacaccaccagcccctctagtaatgtcaagatttgagagaagtatctagtagctcttccttctcaaaaggtgatgggttcctgggctgcaatgtatttttgaaaaatcatatctcaatcttggaataataagcaggcaagtctgtcagttaaaaggtacttaagtatatgatttaattcatattatgtaatttttttctgcaaatatgttcaggaactcagctgcagtgttggtttttctttaaagatttttttccctttcccctagtgaaccagaacagattcttggagcttgctattgattacgcagatggatgggtctttctgagctaggaggagagaactaggataaatagagtccattttttttccaaaagcctgaaaagcccatgaattcacctggtattctggcaagagctgttacttcttaaagcaaaaagggcattgaataggtttttcataggatggcccttcaaataactactcctagccaacaaaatattttagaagcttgctttgccatgtgctcttgtaggaacctagaaaatttccattatcagctgttttcaaagaaaatatttattttctttttattttataaaaggaaaagttaattcatgaaatataaataaattctcagattggctattatttgcttaatagccaataataaaagagcaactgctattgattgcagagaaagtcagtgaacaactttgtgaatcaggggtctgttgatagcttattgttaggggagtaatttgcgaggttgagatcctatgctctgactgctgatgccattttctgcaaacgttgcctgagccaagtcactgactggcagggcttgtgtatgtgaaatacaaacatacttgtaagatttataaacgattacatggtcacgggcatcttaatggaaagaagactgctaatcattgacattgaatatgtagagaacacttcttttgtaggcagatagacttattaaggtatcttgagtagttctttaatcaccctgtctctgttgccttatttataaaatagtgataagattacttaacctgttaaaattttgtgagaaataaatgagatcataagtgcaatgtgcgcacacaaggcctgtcacttctgaaaaaaatgttggtttcccttttccctctgtgcagaccagcctgcatttaccctttagctgaagcatctaggccaaggatgtgtgtgctcagtgcatagctattgaatgaggaatgggtagaagattgattgaatgaatgaatgaagctagcttatgttcaataaatacctacattagcatttatgggtgaaccctgaatcagttaggaatgcgtcgagtctgtttctaaccaggctgcctcattactgatattaacatttatattccctgaaagcatcagggaatcaggaaaagattctttcccatgttgtttctgttcttacctggccttctttagggacatgaacttcaggtagttctggctattagccactgtacatagacattacatatgcattgtttgttattctcctttgaatttaagattgctctttgactaagaaagtagagtgtttccactctataatttatcgactaagaaaaagaggcaggagaaaaaaaaccacacacaagacaaacatttaacctaaggctttcaggggacaagtgctggtggatttctgtctcttaatgcttgagtattttcctgttttagctgcacgagtgatgaaagtgaggtgaagactgatttaaaggcaccttttagttcaagatgccttgtcttggcaaagattttaagatgaaacaaggtctccgactgagcaggcagttatcattaaatttcgttttcccattgaatttccattttttcccaattgtacaacgtcttgatagcatcactgattcctcatgaaaatacatattttctacttgataaagccacctacaaataacttctcccatcctccaaatcccacaaatgtgatccctactacaattagctaacacctagtcactagttaatctggtagaccttccagttccttcactgcctcttggttccaggtattgcaccagcactgcagaggcaattagggcagaggccttaataagaaggcctccactgaacttaaagccaggcatagggaattcgtgaaagaaaccatagtaaggtgtgagaattgccagattaagacagggataaagtactcttgaaatatccaaacagaacacttacttttgcccagaaggcagaagcttgaggaaggccacaagaaggagatatttcaattagatgcttttataaatgaattttaaaaatccccatatgggtcaaatgaattctaagtgaagaaaacagtgtggtctgtggaatagaaatacggaattttatagaatctcgtgcaaacaggaattattttactccagctagtaaagcaggtgtttgaagcaggtggcggggagttggcatgagggtggccgtcagtgaggccagagaagaccccaggccaggtggaacatgtccctgttgtacggaagtccagagctagtgagctgatgctcatgcatcatttgaaatagtaaacatggaaattaaggcatgtgctgttcagaaggctcagtaaataacatgtggagttaatgcttcctgtatacatgtagacttaggtaagcaaagcctgaggttcttgggccttttcacttgctattgccatggaagagccaacaaactatctctctcagttccagcagtcctggttcatggctatttacatgcaaatgtcaacaccagattgaaaacatcagagtgattttgctataaataaaaagtacattagacttttagattttctttgggatctgttagtgagcattacctgtgcgtgcagacctgtacaagacatcttggaagtgataggaaaaaacagcattctcgtgtgtagtagatagattcctattttcacacccttctctagatatctgtcagatgatcttatactcatatttttgaggaagcaagagtgggatatctgttagagccccatttgggcaaagagtaaatagaggggcacagtttttatggaagcctggaatgatggattacattttaataaggagagaaatttggttgcagggatacgaataagcaggttgaatggaggggcagactgggaggctgagtctcaggaccgcagggccagagcagcacctgcaggtgagaggtctgcagagaatggcagcatgtttggagtgcatgtgaggcaggggcatgggggcttagagtgctcctcttctcatggtgggctcacatatgtgatgtctacttgtgtttggaagcctgggtgacaggtagaccacctgtgaaggatggggaaagagattcctcactttagtagcattatcaagttcaagcaccagtatggaaataggaagaaagcaaaagtatgtactcctcccggctaagcaggttgtgagaatcccagcatccttgcacaccctgggatgcgctcaccacagaggggtgtgcgctggtctcaagggaaaaacagaagcaggcctttttgaattgaagtgcaattggtgtaatataggcaaaatagcaactcttttcctaaaggaacatatcgtgcccaattttaattagctctgatgaagtctaggaaaatgggtgactcgtcagagaagctgttaaacttcagagaaaaactgcctatagccccaaggtattccttactttgacaaaattcttatttttccttaagtgtttgtcactgtgaaacccgtcccatttccaggtgccgtcactgttggtatagcttgaaaaagcaacacacttcctatggtaagggcagcttatgggtgtttgcaggtgcaaggcaaagagacacaaaaatctagatgtcagaaagaaaatataaccagggggtgaaatagaagggaattatcataaaaatcaagatgaattggtaatgaatcagatgcatatttttttctctttttgaacagttttattgagatattaatggcatacaacaaattgcacatattttaaagtgcacacattaataagctttggtgtatgtatacatccagaaactcacccctcaatcaagatgctgaatgtgtgtgtctctcctgagagtttcctccacgccctctgtgacacctcacctcgctcctcccaggcagccagagatgccctttctgccatggaatgtttgtgtgcatttcctagaacgatacataaatggaaccatataggatgaattctttcgttgtcagacttccttctttatcccttccaataggcgtatagcaatatctcattgtggtttcgttcgcacttgcctagtgagaaatgttgttgaaaagtttttcgtggacttattcgtctctcctctgtcttctttggtaaaatacctggtcaaatccattgtcagttgtataattggattttgtcttgttttattttgttaccatttaattttgagagtttcaagaaatatattctggatacaattcctttgacaaatatatcgttggcaaatattttctctcactctagctcttcttttctttcattctcttaacagtatcattagaaaataaaattcctcattttgatgacgtccagtttgccagttggttctcttatagattatgcttttggtgactgcctaggaaatctctgcctagtagagagggtcacaaggttctcttctatcttttttttctagaagttttaacatttaggtctgtggttcattttgagataattgtatattgtatgaagtacgggttgaagttcattttttctgcatatggctatctagtcattccaataccatttctcgaaaagacgatccttcctccttgaaatatggcagtaacaaattatagcacatgtgatataaatgacttgcaaagccacacttccaacctgcattaggaatggacggttacaagggccgctccaggagcccacctggaggaaaatggaaactgccattggctggcagcctgttgggtaagaatggaaactgccgttggctggcagcctgttgggtaagaatggaaactgccattggccggcagcctgttgggtaagaatggaaactgccattggccggcagcctgttgggtaaaccgcatcaggctgcattcacggatgctcttctgtggcactgatgggatgactccaggaagtctatggggaagtaccacaaaatgtggaggaagatggcactagacacctgaggagggaccacatgacctccatccaggtgccaaataattacagttgagatgatttccctgcctctactaacccaaattcacccaaattcattgtccacgttggtgttaggtgatatttccaaaaaattctgttatgccactcctttgaaaatttcctaggaacctcaggtaggtccttcttcttcagagttctagaggacagcagtgtgtccttgcactccctgccatcttccagcaggaccctgtgctcagccctgctttccacctgtgcctcgttcttacatgccttgtgtgagggatgtggcttttccctttttcggtttggcaaacaccttctcccttttcaagaccctctctgaaaacacctcatgtactcctgttggtattagcccctcttactttgtgccaccagatcagtttctgtctctaaatatcattttcgctccatcggatagaataactgttcctcctctcctctctgttctgtgtttccccacagagctgtgatggatggaggcctgtttgctgttagatctgctacagctggaatgtaatcttgcttggagtaagaacttacaaatgggccgggcacggtggctcatgcctgtaatcccagcactttgggaggcagaggcgagtggatcacttgaggtcaggagttggagaccagcctggccaacatggtgaaaccctgtctctactaaaaatacaaaaattagctgggcacgttggttcacacctgtaatccaagctattcaggaggctgcagcagaagaatcccttgaacccaggaggtggaggttgcagtgagctgagattgtgccgctgcactccagcctgggtgacagagcaagactctgtctcaaaaaacaaaacaaaactcacaaatgttcatttagtgaatgagtaaatgaattcagtgaatttctgtgttattcatactcatcctactttcatggagtttttatgaaaaggatgatgaccttcagccatggggagcattgcactgcctccttccaaggaccacctgggctccctggccatgagccagttgccccaaaggcatttgacttagattaacctgaaaacatcgatgtcatcatccctcagccctgctcagaaagctgcagggagccttcaccctttcaggaccgaggccaagctccccaggctggctttatacatcctctaacagaagctggccctatcccgtttccacttaattgactcttccccatgggatactctccttaattaaaattcatctctaccccctaataagcgtatgtgttcctacctccatgactttgcaccctgaaatgctctcagattccagtaaaatctcccttctcctctttaatctccaagtttctatgttttggggctctgagtctcttctccccataaagtctccctttctgaatttccagcctcactgcccactgaacatctaaccagatactgctttgtgtattgagtttgatggtataattagatggtgtatatttctgccacccacggcacagcctggtgaattgcaatctttattcattgatattgtgatagcagtgaacttgggtgtggggaaagtttaatgaaggtcaagcagaagatatgtaaagctctaaatacagagagtgatgatttattcagagaaataagagaatccatggggaataccagactctagcttccttgtggacaagaagcattcctgtgcctctgtgtgctctgtgctccttctccctaactagatccccacccttgccctagcttggtgcactgataccatacgtcgatgcagacactaaagagatgacttccacctcctcacaaatattcaggtagaagaccttccctcggaacacccggtcatcagagagtgttcctgatttcgcttttgcaaacaagaggtagtccagcttggaagaacatccagcgccttccctgaaattcatctgttctccactttccactcttgactgtcataacaaaggacagttgtaggtggtgcccagtgacccaactcagtcagctttatctattggcaataaggtagtattgacatatcaatatttccttgccaagatgctcatttgttcttaataagaatcaataatgttcaattaatatagattatgtcactaagtagttaatttagaatgtcgttgctttgcagttcatatcctaacccacctgatcctaacagcatccacctaggagcccagaccgttgggaaggagaagagcagaaaacctaactggtccacctggaagacctagaatttcattccagcaggagcggcccacccaggaaagggcctccctcccacagcagctgctgggaatcactctctttgatgacatcattgtcatctgggcagggagcagaaccattttggggtttcccatccattcagtgctcccactgaggtcttggagtatggcccagatggctgtagatgtgcaaacttacgatcatcctggagcacggggccctgtgtcatatggatcctgcttgatgtgtagatagtgcattattttcctacttgagctctttccttttccaggtacatagacagggttgccttgaggcttagtcacccttcgcccattctgtcttactactacagagggtgagagactggacaaaggggccctcagtgtaattttcacttcacatattttattattattttttttttgagatagggtctcactctgtcgcccaggctggagtgcagtggcgtgatctctactcactgcaacctccacctcctgggttcaagtgattctcgtgcctcagcctcccaagtagctggaattgcaggtgtgtgccaccacacctggctcatttttttgtattcttagtagagatggagtttcaccatgttggccaggctggtcttgaactcctgacttcaaatgatctgcccgcctcggccacccaaagtgctgggattacaggcgtgagccactgcacccggcctcacttcacatattttaaatttattccagtagtctaagcattatgcaactctggttagataatgaaggtcatgatacacctagaaggttacagatttcaactggattaaccattgttatacaaacatatgtgcatgtggatatcagaggattcagagcctctctcctctgttttgtaaattgaccttcagtctctcatcttaggaatgactcttggccttggatgagggcctgacgagggtgggttgagttggtaaaacccggctgtgttagtttccagtccatctgaacccacagccccttttcctggctttccctgctatagcccatgaacacaatcacagtttctgttgatcatcgttatggtcctcccaaatccttcacctgggctattggtttactagggttttttttttttggtggatttgcccaaatgtggggacacctggcaggagacagcagctggggttcctcgaggctgcttggagccctggcccctgagtcaagtcctcacgttcccttttatttccttctcccctaattgcaagtcgtcaggagtttcaaatgcccaccaacatttggagaaggcttgtgggctgtttgcaggctattcagccccaaaggctgtacggagataggtgtgggttatcctaagcgtccctgctcctcatgttgtcactcatccattttcagtaggcgctgctcctaaaatgcacgttaatattgatgctgtttcatccgggttcttttcctttctacattgcctcacctggtttccactattccctagtaactaggtaggagtcatttttttagatgaataattgatttgcttaagggactttgggcaaacttaattggtagctgagttagaagtacacattttgttcatttatttgcccgtcctttagatattcatgaagaatttgcatagaagcctagcactgagtttataataaaaattaacctcatggcatctatactctcagccacttttttttttttctttttttttgagatggagtcttgctcagtcaccaaggctagagtgcagtggtgtgatcctggctcactgcaaggtccgcctcctgggttcaagtgattctcctgcctcagccttctgagtagctgagattacaggcacacaccaccatgcccagcttttttgtgcttttagtagagacaggttttcgccatgttggtcaggctagtgtctaactcctgacctcaagtgatccgcctgcctcagcctcccaaagtgctgggattacaggcgtgagccaccatgccctgctttctcagctactttaaaacaaataacaacaaaaaaatctcctgattgtcagtgcagagccccgcccgtaatgcctggactcacaggctgctgggcttagcagtctcctcaaccccagctgcacaatggaattactcggagcttttaagaaagaaagaaataataataccaattcaaaatcaaacacggaacacatacatcggtcatcagtcacataccatagattcttatttaatcagtccagggtgtagcttggctttggaaggctttttctttcctggctcctttttttttaaacaattttttattgatgcataatcaatgcatatagttttggggtacatgtgataattaagtacattcatataatttgtaaagagcaaatcagagtacttaggatcttcattaccttaaatatttgtctttatgctaggaacattcaaatgattcccttctcgctattttgaaatgcacagtagatgagtgtatgctgcagccaccctgctgatctatcgaacgctagtgtgcagctgagggtgagaaccgccgggtggagattggaggagacctgagtctttaataaacactgagccgctggggaaaaggtttgaggggcatttgctaacacaaatgctaaaggtcagtactaaaaactactcaggccattcttaggcatttttgtcttagaaaatgtcaaaacagctgtgacctcatgatttctgtctcgtgaggactctgaagaatgccttagtgctcctgaattaggttgtaaatattgtacttttttctcttgagttttctttggaagaatagtgaatgattaaaagaaaaccaaagcagtactattattttagaatacggaaatgcaaggtagcaaagtgtctaacacctagaaagttagccccgcctggacaccagctgtgaagctctgtattaattgaacaaatgctgtccaagaaagcaaaacttcctaatctcttctgatggtcctcaatataagattagtatagaatcttcttagaattggtttcctttaaaaaaaaaaattgtgggcttctcttccccatcaaaatgacatccctttgagattaatgcaggaagcagagggcacggtggaacttgtctcgctgaatattctgacgtggtcaagtttcctaatcaacagcagagatacaaacttgcattatagttgtgggtggtggggaaaggattgcctttttttgttgttgtttttttttgagatggagtttccctcctgtcccccaggctggaatgcagtggtgcgatctcggctaactgcaacctccgcctcctggattcaagaaattttcctgcctcagcctgccgagtagctgggattacaggcacctgccaccatgcccagctaattttttgtatttgtagtagagacagggtttcaccatgttggccaagctagtcttgaactcctgacctcaggtgatccacccaccttggcctcccaaagtgctgggattacagatgtgagccaccacgcctgaccaggattgtcctgtaaaagtgaatttttctaggcaattgaagattgttaaaagtgggttaaggcttatgcctacctaaaacattcattccaattagggcctcatccacatttaaattccagattctgaaaacccttcactcctaaataagaaagtattggggcagcaggtcccacgccggactgtggaggttggctacgtgcagtgaatgagtcatttctgtaccctctagtgtatgtgtaaggtacagctgcagatagatccataggaaacagggactccaagaatagcagttagtaaatccgtgatccgtgtgtcatggttctattgaaaggaaagtgtaaccacatcagtgggtctgcataccattgaaaagagtttctcaatcaaaaacctaaacacatgtcctgaaaccatcacttaagcactctgagatcttgatccaattacctaaacttcctagatctgttttttaattttttttgttaaatcattgcaataattcttgtatcacagagttactccagagattaaataaggcagcgcatctcaaacacttaccagtttttgttaaattaggacctttttcacccactacagttagtagtacctaaaagtggagctacgactagttttcttggagtgagttttgggaatttaaataagtaaatcgtgtgatggagtttggaagtgataaagcactatataaaatgctcatgcatttccccatttcccaaatgtccatggcatgagtcgtgcattccagatgcctggtgtgttctgggaatgcaaggctggccatgcgctgggtctctcctcatagggtttacagtcagttaacagcaatgcacacaaaaggatgtattgaaatagatccattggaggagtaaaaatacggtgacaataaggggacagagaagaaaacagacaaccatggccagctcctaccggaacagtggtaaggatgccgaacacattcatacatttctgtgaaaatgcaagcccttccatttcattttggttagtaataatcatatattttggccaggcttccctcccccaatttcctacggctctgcacttgacattcaccaaaaccctgttagtttcccccaaaccggacgtgattccactcctccatccttctgcccctttccgagcagcttccttcagggctcacccacacctggaattcagcaccagctattacatctgcatgtcggctcctgtgaacccgtcatcccctcctactacaggccggggccactgggccctgttagttcagggcccctccattccccagaatcttcttccactcacaacagggcaagggtttttaacatgcctccttccttccatgccttgagcttcttgcaggcaaataacaaaggcattttgtctgagtccccagagctaagcacagaacctggactatattaggcctttaatttttttccaaatgtcagctaacaggcacaggcatgcatacatacacacgaagcattttatttttttacctgatggggacacaggccagggtttgacttaggagtacataataaggattgacaatcaggacattaaagcagataactttgggttcaagttctgattttgccgcttactaggtggtgaccttgaataaattacttaaattaagattttcccactcacttgaaaatggggataataaaaatcataacaatacattttggagagtattaaatacggaaatgagctaaagttagctcatgcccggcatataatgtttgcagctagcatttagagtgcatggggctgctgatgtgttgatgcctgaagttgcgcaaatacaggtgggtagtggaatacggaaacaatgatcccataaaccaggcccaaagccccatcactgaaggaatgcttaccttagcctgaattttccagtatcctctacatgccacaggcagagccaccacccagagttgaagccatctgaaggtgacatgctgcagccttgtcctcgcaggtcattcttcagcctcctgacctctgctcagaagcctgtctgtgcttacggactgggctctgcacagctgtcacatcctatcactgcccctccaggtttgcagtcaaagaccacagcagagatgaggcataatgaaggacagacacacccaactgagcaccaagcaagcgacatatcctaatacatatgtgcgatgtgtgcatgtaagggcaggagagcaggagagaattggaggaaatagctgcaaccaaaagtgaagaaataataagacacctggaaagaggcctctctcttctgatctgtgaggccgtagtgcagtggaagcgcctgatctagagagaggcaggcggatatttgtccaaactgcagctcacacctgtaaccccgtttccctcctcaagtcgtctacatttactttgcctcagtttcttataagaagatagaggcagtaacatctatttttgtgtgtttttgtgaaaatgacatattatagagaaagagtctgttaaaaatagaagtgcttaataaatagttgctattgtaagtggatgtcagaggagctgttacaatatatcccagaaagtgagccctgggaaggcgccgattttccatagcaatcctgtttctgctttacagttgcttcctcttacgtgcatttacctgcctggtcatcctgcagggcagtgccacctgcgcagtggtgtgttgcatccaggaacaatgtccacatgatcagtgtcaggcacagagtggcatgggcatcctcaccattctgtctccagtcccatccgtggacaaaatgccccctggaaagttgaacagagattgcttcaaatgggccaaatatgcattagtgaggaactaaactgctttgacagctcctgtgtctcctggatgggaagtggggagggagtcatggagttttaatctcatcctctttgtggcactgggcacgccactcaagatccctgcttatttccagcttatagcatagaatgagaagccattcacccttgtgtagagtgatgctgggaagaattaattattcaatgacttaagggtgcttctgatatcaaaagagcccattatcatcatcggcctcctctccccagtgtgaacacacggcaaacctgagactcattggaagggacgctgctcagacctgcgagccccatttccatgggtaggtgaaatgtctcatggctgccgacacccttgcggcaggtcctgggcgtggttaagtagggggaaagtgtatttcttttctgtggcaagatttattctgtaggagagctcatactttggaagcagcaataacctaggactgctcttaactagcttgatgaccttgtgtgtgtgtgtgtctgtacgtgtgtgagtatgtgtacctgcatgtgtttataccgtatatatggatatatgtgtactccggaactcataatatatacagttataaccattgttcaatcataagctgaatatgcatgagtcactctttcctgcactgaactccattttgtctgtcacaggcgttagatgacagcttagatcatagcctgctccaatctttacattttaataagcaccttttttcaatgccactctgatacaccctctggtccttcattagtcattgctgatattatttctctctaagtgcttcttcctccattttaaagaacaacttcgatgtggttttttttttctgttttttaaattaaactttgtattttgagataattgcagattcacatgcacttacaggaaataatacagagagagcccttgtaccctttccccagtttcctccagtggtaacacccaggacattgacatggatgtagtcatgatacaggacatttctgtcctcacaggacccctcctgttgtctttatgaccactccctccaagccctacccatccagaaccctgacaaccactgatccattctcatttctataatcttgtcatttcatgtagttaaataaatggagccataggtgtgtgaccttttgggattggcttttttcctcttggcatatttctctggggatcatgtatatacactgatatggtttcaatcttggaggaatcctgattctgaaatcctagagtccaaatctgatgatttcagggctgaacagttcccttctttgagtgatgaggacctgaaggctgagagacctgaggtgtcatgcccagggatcacccatggcacagcctgagctcacagcagagatccggcctccaggcccggagcactcctccgccatgaggtcttttacagctcagactgggcaaagctctttttaattccaccaaacctagaattgttaaaaaaaaaaaaaaattaattaattaattaactaaaaacgctcaagatgccctcttactgccagccacaaaggggattctcagccatcccagcctttgtgggcactggagcagccgtggcctctcttggtcctgcctgtgtgtgcaggagcaggcacaagtgggctcaggctgatgcccccagaccaccctcggcctctgacccttgcctgaggctggcctccacaccatgatgccatccaaggaaaggcatctccttaatgcctctgagagttccatttgtaaacatttttgaatgaaggtctctaaagaagcagccaaagggcaggatgtcccacaacacaaaataagacatcctccttatgctgtctctgaccaaagtcctcatgctcacacagctggcccttccctctcttctcttcttctcttccttcccctcaaagaatatcccagcctctatcaaccagcaccgtggctctcatcaagatctttgccggtcctcggcccttgttctccgaacctctgtgctctcttacataaattagcaacctcctctggcatctctaagcctgtgcaccacccattccccttgtcccatagcacaggcagcacagaggcatggcatgccagagaaagcaaagaagggagaagccttaaattcctgtccttgaatatgctcttgccccagacatattgctcatcgggggtcataacagctcgcaaagcaaccttttcacgtacctgagaaactctcccaacgtgtccaagcccgtatagctgagtcacttgacctttcttcactatgacctcacctacctgggccctcaccaatccatccagataattgtaagattgtataaagttgaccgctttctcaatgcattctcttttctcatcaagatatcagaaatctttgacatgccctagaaaaaaatgcatgtgatacggggttttactgtagagcgatggaaatgttttggaactggatggaagtggtggctgcacaatgctgggaatgtactaaatagatgacatggaattgttcactttgaaatggttaatgctgtgtgatgtgaatttcacctgcatacattatttttaaatgcgtatggggtcacttccaaggtgaagtgcccagtcttctttcagacatgaggtgtagctagagcattcatgaaggtatgcaaggaagggctgagatgagcagcaaggggtggaaaggaaagggtaccgaagtgctgctgtgctccacgctggccccttacatagctggagacacaaaagtggggcctttgcgtatccagattcgaagaatttgatgagggcattatcaagatgaaaatgtggaatattgttgttggcaaagccacattaacacacccacatagcacacatataaaagttctaatgactgtctggtgctttaaaatccagggcttaatacaagcaactcaagttaaccaatttaactgtgaaaacccaatcataggcatttcctgacattttgaatttgcaattgtaatgccgttggtgtccatgtagtaaaaaagtgcaatatttggaggatgcgtattttacttttagattttatatatttatcaattggcatgatcttaaaaaaaatctagcattaacaccaaacatatacaagtgttgtatttaatgtctgtgcacctaaatcagaccagtcagaccacttcacctgttgggctctccaaagcttttcagaaacacagcttatcattcacggacacctctgaagaccagaggcattgtctgctgaggctgcatagttgcttagggcctgaaaactttgtatggtagtttgtaatttgcaatgaatcagttacagccagaattaagatgattttcactctaactacaaaacaagtttgactgtaaacaaacctagagcaatatacagagtatatctggaagagatcttccaatacatactatctttttataaatgaagaagcagaacccagagaatctttttttggaaagggaatttgaagaagaaataatttttttaacgtagccggatgcgatggcgcaggcctgtaatcccagctactcgagaggctgaggcaggagaatcacttgaacctgggaggcagaggttgcagtgggccacgatcatgccactgcactccagcctgggcaacagagtgagactgcctcaaaaaaaaaaaaaaatttaagaatatgtgtattcccgttttttacatgtaattgggtatttctaattacatatcacttgttttttattcctgtgatatgataaagaaaacaggcattggttactggttccttgttatttaataaaagaaagaaaaataaacaacctctataagtgttaactaacttggcaaagcaagccttgatttccggcagtcacttagggaagaaagaggccctggaactctggaccccataatatcaaaaactttcactactggaatgcctcatagcatttacagagatccagaaatggaggctgcaaaaattatgactaggtaagagttggctagagacaaggaagcatttccttggccaaaaatagagctgaactctccttgctgttgccagcattacaccacatacatttccaccagttatttgaagaccccttcacaaccaaagacagccagggcttcgcaaggcccagacaccccgctgactcatcccatctgcagcgtgcaaagtgctatttgtcactgcctagttatattccactctgcccaacagaataaatattaagtaagcgctatgtacttacataatttgcagaattgatcggctgacttaaaagcttgaatccccaacaaaagaaaatggagtgctttgtgcaaatgttaaatgcacagtttaattggcaattgtgtgttggaaagctattgtaaaaggatcacagttttgaggtgatgctccagatagcacagtcagggaaataagttttcatctttggcattaaaaaatcaggtcttggaattgaagtaaaaaaaaaaaaatagggcagcctcagtctggatctctgtctcatcagaatataactttcttcctcctacactctgcctcctaaatcagaatttagaacatattaaatatgtaggctttaaagattctttccttgcctaaataatttatacacgtctactaaactgttaaatatcaaagaaacacatgcacatggacacacacactcagagcattttacaacagtgatttccacctcccaaaaatttaagaacgtgctcagcaggaagttagagttgtcaggtcccctccagtggaaacttaaagaaatgtgttgtattttgtttcaatgaggatctggatggagagttcgccatcttgattcacgtaacaaaaataggtgagagatacatgtgatccccgaggagaactattagacttcccttagatgcaaaggttgtctcagtcgtgaaaaaaacgtgtgtcatttcagcctattcagtgcattctgcagcacctgctagaatatttatcctccttctctttccacttaagtcctacatttacataaaggctactggagggttccatgttgaagcaggttttatttgcaaaactcagcctccatggatgtgtctttctgcagcattcctttgtgcctctcattatcacctaagggtttataaaatgggcagtggtaactctagttttaaatctagttaactctagagattaaaatccagtaactctagattaaaatctagtaactctcagctattgtgaacaagttgaagttaaaaaaaaaaaacaaaaaacctttcttcagctgcgactgaaaaagatccagtgataccaagcgtacctagtttccatcctcataaaataatctcttaagtgtaaagaagcccagtgcaaaccaccatgaattatcatcatcgtttcctacagtgagttcggaaattgctttttgcttctggatactgtgaaaagccaggtcaggaatccacaatgggcatcagtcatcattgtgttgctaatacttgccatcggttcaagaataggaatattaagattgcatttcttcattcttccttgccaaagggaggaacaagacagtcaaagggcatggacccctggcccttgattgaaaacactaacagatatgcatgcagttagaccccagtgttcatgtgtccaaggcaataggacttccaggagagacatccaagtgaggaagctgcaagtgctgcctggaaacacctctatcttcaaactccaccctctctggcttggttgggaaaacctcattactctcaattttctaccaaatgatggtgaagaggagtcatttgttggaagaaagggattcattacagggaaacaggtcttgaaaaggatcaataccatggctgcctccttgtccagccaaggggaacctgtgtggctctcccaagcctgctctccttcaggccctcagaagttcatgctgtcattaggacagtcctgcagtcaatggcagggggcgtgatgtcccgaggtgtgtgaggtcttccctgagcaaacctgtcctttccagtgacctgccacggtgcccaaaattctctcatccaacactgtgttagtgagttgcttgaactctggggccaggctgcagaattgagtgccagcttttcttcttactaactggataacttctggcaaaatttaaaatagcagtaattgcagtatctacctgataatggtgttggaaggattctatgattaatacctaggaaaaacttgtgagtgtctggtgcattctactatgcaataacattagttatttttattatttaacctcagtgtgttgtctggcaaatagaagacacagtcagcaaaacacagaaattcgttaatgaagtgaccgccaggcacctggacgagccctgagggtataggcaaagacatgctggtagaggaaggggtaagagagacctgaaaattgaggtctgtccagggaggccgggctggagacaccctgagttcctagaaagagcaagttatctatgagggagaagagaaccattatagtggtaattgtgcaaaaaggaaaaaaaaagacaaaagaaaaaggcagccgtaatcgttagatgccagggacagtgctaaccactttatttatatcatccaatttgatcctaaagcaatcttataagctgggtatattctcatttcatagaaaaagaaacaggcctggagtgccctctcagttagtcgatagtggagctgggagctaaactgttgcccaaactggatccatccagctggcacaggtcataggaaccccggggtctcagcacttcccagatgcctctgttagtgcttcctcttacttggacccagttgtcttaggaaagcaagacagcagagaagcccagctcctttctctcttcctggtacagaaccagcatcagcattatttagaatccagatgtggccaatgtgggatggctggaggagggaacaagctggcagacagcccccacctgggcataggtacatgacaggagggaacgagcaggcagacagcccccacctgggcataggttcatgaggaggaaaacctgccaggaggattccacacctgagtcagggagtcactgggtttttccagcgagcacccctcacgtccatctccatgtttcttcccgaccccttcgctctggaagtgaggagagggaagtgttaccagttgatgttgtttatgtaatgctaggatcagccaaagagtgaacatcctgctctttcaaaatgaattgttggtttgtaagggtgtttgctgaccttttcaccagtaccggggaagaaatgcgcatttatggctctctttttggctttagaacagataatcccagggcccaatctttgccctcttctccacctccatacacacaaggaggcattggtctgcggaaactgtttactcagaggaccagtggccctcgtgcaactgcagtcaccaagttgccatccgggctgcagctttcagctggctctcctctgtgtctgtgctggaggtgatgaaaccccaggcttccacctgccctcatcagggtccacacagggaagggacagccttgtcttgaggcctttcatgctgaatctaaacctccccattatgaattgacgtggtgttacttgggaagggatgatatttctcaaactcctcctgtgggcttgtcacagcgccctgccccttcctccctcatctcagctgcccctcactgggcatcggggacaggcaggtattcttcactttatacatgagaaaggcaggcccagacagggtgggtaccttgcctccatcacatggctcatcagtgctggacaatcgagtatgaaactgccatcactcccatgcctgcctcttctctgtggagacaacttcaacttcagaaaacgttagtgagtcttatcatattcctacagccacattccagaacatgctgattttctcatttcaggacagtttccccaggcgctttcaacttcttataccttaaaagaaataccaaatgcattactcatgtctgtgcagtattccctaagaaaataaagacatctagctcataggaattccagaaagataaatgaaaaataaatgaggcttcagaatgctcacaaaacaaggactctatttgccttaaataattaacattgagaattcaaacctgaccaacttttcctccatgattaaagcaacccagggagagggcaggtgattccagtgctgggggtccctttagccataaatgtatggacgtgtgatgccgtagcactcagggcctgggagagccggggagcatgaggatgatcgaggtctcggagctcaatcaatcagcaagtgcttcttggtcacctattgtataagtagaaatggatgccctatttatttatggaaaccatcaattgttgaggacctaatatgtaatctcatctaggataaaatccttgaccttgaaaatcacaatcagctgggagagaacacagagtaattgttagaatgcaagatggcaggtgccatgacagaagagcaggatggatgctgaggagcacacaggtggggtactagctcgggcctcagagcaggcaggaggacctcatccaggaaacatctctgagttcacttcccaaggacaagtttagccccaggacaaggaggagatccagaaggcattctacaaaaatgctcaaggaacaagggcattggagcacaccatgttggcagggaaacagacaaagaccagacatcagcgcttgctcagaatcctctgctgctctcgaagggctgtgtcctccacaggtgggaggatgccacctgctctgatggtccaagcagtgtgggttcagccagcgctcttggcacctgggagcatgattccaaatgtagacgtaatccagacctgcagcttcaaaaaaggagccaccgtggtcagggtcagggctgacacagggccaggggaagagagtttgcaagtagcaattcaatacttttatttcagaatgtgtagcaagtatttgacatatatgtataaacaaaaatcatataaccagtttcctagaggtagtccaggccatgaaggctgcaacttattgtttctctgccctgacttaaagcatgtgtttccaagttgatgcctgttctttttatgcctcatcaccaccctgagtgttcagtgaggaattgctgcaaggacaaagagttcccaatgtaatgtggatacaaaagaatccaaccactcagcttcatcagtgcccttggcaatgcacgtccaagaagcctcgcacacagagctgggaggccatctgaggtctgaccactgtgcctgccagaagatgagcattctgtttgtctctacagttgtgtgtgccctgtggcactttcacatattaagatttgaaccccaccaccccccaaccctgtgactgatccccacagcctcccctttagcctgggtgaattaattgaaatcataggagcagtcttagctgtgcccgtcatgcggtcccttgagacaaatgcattcggtagatgatacatgacagcctgaacacaggccagggaggagaccctggaaaagcagggacagaaggaagacaacttcccagccagcggccttcgcttcaagacagaatccactctcctccctgctcaccagtaacatgagggctgagcaaatgggaagatggtctttgagagttatcgacttcctccttttccagcaacgacatcatgcctctaagtagcagttcttaggaaacatgaagcccccaaggacagctggctggaaactttcaaagctttgcaggcataaccactaatgaggagcaaagtcgctgtttatttgagatggtgacagacactatcagcacacttcacacagttcagatatgtgtttaggttcagaatgatggggatttcaagaccaaaggctctcgaaaatttcagcaacccaatttattcaccaaagcattaagccaggatctattttacatcagattgtttgaaatagtgatgtaagaaatgtgctcttgatgtggagcctccagaaaaggacttgatgtgctcatgggttctcatgacctctgaggtctttgctgcagagaattcaccagcctagtgcctggcacatcacaggtgctgtgttaactgaaagaatgatgaattattaaataaacagccactgtgatgtggagaggaaagagttgggcacacttgggttcaaagagcaccacctccaaacgccaccttgcctgcctacttctgatggacactgttagcaaattgcttaaacactccaagtttgtgtttccttatcagtaaactagggataaaaatatgtatcttcactgggcatggtggctcacacctgtaattccaacactttgggaggctgaggtgggtggattgcttgagcctaagagttcgagaccaggctgggaaacatagtgagacccgtctttaccaaaagtagaaagaaattagccaggtgtgggggtgtgtgcctatagtcctagctagttaggaggctcaggtgggaggatggcttgagtccagaaagtcaaggatgctgtgagtcatgactgtgctgctgcactgtagcctgggtgacacagtgggatccagtctcaaaacaaaatatgtgtcttgcagtgttgttgtaagccttgatgcactctttcctagtgtaccgaagcagcctaataaatgttagccccccggttgcctttccacttaaagagagatggggtgtattagcccattttcacagtgctataaaggtactacctgagactgggtaatttatgaagaaaacaggtttaattcactcacagttctacatggctggggaggtctcaggaaagttacagtgatggcggaaggtggaaggcaaaggggaagcgaggcatgttttacatggcagcaggagacaaagcatgcaggggaaactgacattttgaagccatcagattgcatgagaactttctatcatgagaacagcatatgggaaacctcccccgtaatacagtcacctcccaccaggtcccctcctccacaggtggggattacaattcaagatgagatttgggtggggacacagagccaaaccatatcatgaggaggttatatcaagtggatttatagaactgagaaacagttgagaggctctgtggtgtgcggatggttttggaggttaaacaaaacaaagaatactaataccagagttccttccttgaagccagttaagatcgtcacactcaaagggaagagatagactttatcttgtctctcccagtagattgataatggcaggaggagaaagggcctttcctatcctttctatgcaaaagtgtggtgtctggaacagcatctgggtgtcaccagacagtcttttggaaatgcagcatctcagcttccacctaagtaggctggcccagaatcaacatgatgaggagatccccaaatagtttacttgcactttgaaaagaaacactggcctagagcaccttcccctctctgggtcgccaggttctttgatttattaagtctctgcagctgactgatatggagggcaagggtacttttgaggaattttctgaatagtaggctgaattcttcaaccagccaaccaaacaacagcatgaatctatcttatactagatacgtactgcttcttctaaaaggctgcagagagggcagtcgtgggcccagtgaacagctgcattctggtcggtcctctttttcccttcctctgccaggaaccacagcagtgttgaggttctgtaagcacgtgcccagttggcaatgagcttatctctgagcatctgaacagaggagaagcccagagcagcctggctccagggaccccacgggacgcattgagtgctgagctaactcagggaggagaccacaacaaatacaaactctgggaaatcagggacagggcaagcctcttgggattcatccccggcggacatgcccagagactgtctgccacagcttttggcaatgacagatcttaccatagggctcctactaaataccctctggaaaagcactggacagtgacccttacttgaggatgcataatcaagggtgtggtcatgtagccatcataacatagggatttggaagattgaggtatgcggaagggccagttccaggaatagagctcatgcttggtccaaggactagggcagggccttcaggagctcgtggctttgaggagggataaaggagaaggattggtagcaaatggcccagagattcttacaaatccaccttcatccataaggaggttggagggtgtatgatgatcctctcttctaaaaggctccctttcaaattacagaaccattgggtaattcttctattacccagggaatcagtgccagctccccaggcactgagtcccaggaggaagacagctcatcttcattcgtgggaacctgtcctatatgtgattgtgcccttgggtaaagtggactttacaagttcgttattgctgttgtttgagcagaggtcatgttttttgtgttactgttgtttttttttttttttttcaaattataaacctcatatatatgttaaagcttaaattcaatctgatgtagagatttaactgtggaagtgaaacctctctaaaaaaaaaaaagatcctaggaaacaactagaaatatgagatttattctaatcctaattgcatgttccatatttagacacccttcccacaaaaggtgagagaaatgcttaccttgtccaattttacgcacaagcctccactttaaggaaacagattactttttttttttaaagaactctcaaattacccattgataaatacagcactcaaatttttttttggaaaaggcacaaaggtaaacagataaaggagttgagtggtcacctcatgacaaggacagtttgagggtttactcttgttttcatgggagcattggtgcgggttacttcatctgaaagaaactttgagctctgaagctatgtctagcacatgttaagtaagagtggtccttggaaatttcaagcgttggtttgcatggaagcacaaatcatttgacccacatgaaaagaatgaaatgggatggaacagaaactcaaatttaaagtattaagtgcttttgtcaactgcaaataacatgtctctgggatgttagtgtgtaaattgggcagtaagattccatgtgtattagaaataaacttaattatttaggaggtagggtggacctcttcttacaaaattatattttctaaaagaaaataaaagcctatgagctatcaacagacatattgttgtaacaacataaaaagtacatctttagccagctttcactcatccaggctagtgcaaataaggtgtctattaagaaatggacaggtcatgctcaaaccttccacgaggctgtggtcccatctcatccctttctcactctgacaggggcacagtgaacttcctagtccattccatgtcctgcccagctcagggtggaggagccaaagagccctgctgtgaccacccaggagggagagagggaagggcttggttcctccacgctgcccaagcctggtctgtctcagagggcagggctgaggaccagagcgcctgtgggccagatctggagcagctggcgggagtgaatgacctgtgattctgcgtcctccctctactgtggtttcctgtctctgaaaccttatttctctcagcatcctgactataattaacatatgaaaaaaagaagccaaataaatcaagagaggctgaagcccttcgcatttaaaatccatccaccatcgtttcccccattttatcagctgtgcatgtgctgagatggattatgcattgacactgtctttgaatagagggtgagttgggatcctggtaaagcagccattagaccattaaaggcagtaggagagatgcaggaagtgccaggatcactagaatctggggtccctaatccacacaacctcacccagccttacaacaagtcctgtcaccctgaactgcccaggcttacagagtaccttcaaagatgtgaaggggcagcttatctttcaaggtaaccaaaatatcatcttgatattaaatcagattacttggctaattcatcagtttccctcagagttaggtaccctgcacatgtcgttgtcacctttagatggcctcatgcatgggaatgtgaattattcataggctttctttgggttgcaggaaaccttcatattgctttagtttcttaatgtatttgataggctctttgtgtatgatcacattatatgggtattgctggcagtacagtaaattttaaattatatagtctgcagctttgcactaagacatggtaggagatgattcatcattttccttgtcttcctgtttacatgcggacatataattcatgctcagaaactatctttcagctcatctggaagtgctccactgcaccaccacagaatctatctctgccagtccagaattgtaaatcacttttctattaaacagcggggctaaaaatgcaaacatatgtactttaaatatatgtagccatctccaattcccagaagatgagccaaaattaaaggatagtcaaaaaagctagtgctagaatttaatgaatgaatgatttgacttgagatcagaaatttgcatttctgtacacatattgaagatatatatacacacacaggtttcccagaatgggcctgtctttgggaactgtgtattctgcagattttgtacactgaatctctatcattctgaaattttacttcctaagattattcactcatgcagagtcacaagacagacttgatggtggggagaaaaggtctgtataaattctcagtttagcatgatatgaagcccttgtctgccatcctcttgaccttcatccccaggccaagacaatgaagtcatttgctcaggatgatggacatctagactcagtagtgagtgcttttcatctccaaggataagattccacccagcaaatctgcctactcaggcagtagtgggagttagatatttcagaaaggttttcagcagtcactgtttctttgcccaacaatacacatcatcatggttctctactccctgaacctgattcagctgtgatagtggataaccattttcacacacatgctcatgaacatctggcattgttgaagaaggaagacctttccgggtaactgaagcttacccattgaagagttttttgtttaatattgcagctgtcttaatggaatccttctgaactgtattatttgcttgcctactttttttttttctttgagacggagtctcccactatcgttctgttgcccaggctggtgtgcagtggcatgatcttggctcctgcaacctccacctcctgggttcaagtgattctcctgcctcagcctcccaagtagctgggattacaggtgcctgccaccacacctggctaattttttgtgtttttagtagagacatggtttcaccatgttggccaggctggtctcgaactcctgacctcaagtgatctgcctgcctcggcctcccaaagtgctgggattgcagttgtgagccactgtgctcagcctgcttgcctactttattaagcaaaggctgccaaaccatttcatttgtgattctgtgattctgccgagaattgtggtggctgtctgtccctgtagaccattggttgccttgccttggagctcacagcctttcacctgtgctttatattcttgtacatttcaagaactagagttccaaaatccggtttgctagacttgtgctatggtttaaatgtatgttctccctcaaaatgcctatgttggcacttaaaccctaatgtgatagtatcaagagatgggtcctttgcggaagtaattaagtcctgagggctctgccatccttaatgggattaagccccttataaaaggggcttcagagagctgcctggccctttctgctcttccattccttctgtcatgtgaggacacagtaagaaaacaccttagctaatgaacataggaacataaaaccaaacacctcacttataagtgggagataagtgatgtgaactcaggacacaaaaaaagatacaatagaccctgagacctagctaactggggaaggtgggaggagagagaggagcagagaaagcaactattgggcattagacttagtacctgggtgatgaaataatctgcaccacaacctccctgtgacatggatgtacctttataacaaacctgcccatgtgccccgagcctaaattaaaagttaaataaataaaataaaatgccactgggaagcagaaagcagccctcaccagatgccacatctcgtaagacatggagactgttggcacctggatcttggaattccagcctccagaactgtgaaaaaatacattcctgttttttctaaagtacccagtttcaggtatgttgttatagcagcatgaatggactaagacaactcatatgataagctgggctgccaagtcctgcagaaatacctgtgtcctcttcctgcacagtacaggtcagggctttcacgaacaagttttgctgtggctcttctggagttccaggggcccttctgtgagtgggttttggggggctgctttcttccttatttcatggtagtcttgaattagtgataaacagagtttgaccatatgtgtggataacatgtacaggtcttgattgaaactcaagtttgaagagcgtttgctgggtgccaggcataaaaacggggttcctgcttgtattaggcctcaccctcgttatttaattacccactaaaggcctcttaacaaagtcactctggccattaggtttccttttattgttattgttttaagacagagtctcgttctatcacccaggctggagtgcagtggtacgacctcggctcactgcaacttccaccccccgggttcaagcaattctcctgcctcagcctcccaagtagatggaactataggtgcctgccaccatgcccagctaatttttgtatttttattagaggtggggtttcaccatgttggccaggctggtctcaaactcctgacctcaaatgatccacccacttcggcctcccaaagtgctgggattacaggcatgagccactgcacccagcctaccactgtgctcgaccctcattaggtttcaatatatgaatctggggggcatcagaccctagcacagcttctcacatagcccctctcctccccacccagcctctcttcttcctttattacttctgttaagtgcagcctattcattggttgaccttttcagtcctataactcagtggcttagttttttaacaataaatcacaggaaggtggcttaactattgaaaattttattaaaatggttataataatgacttcattactctctgaggcttccagatcttctcttcattccagggaagctggctatgtgaaggcatctgagaattgctattaacctctgctgaattaaaaacaggagcggatgaacaatgttggaagtgggccgagggcttttcagagataatagttgtatgatagcacccccagtttaaatataacacttttgcattataaaaaaggcatattaattcatggtaaattgaaaatttaatttaattttctctagatgagtgaggaaaaaaaaaatgaagactccttactctgcttgattcagttaccatggggatagaacatcttttcgggagaacctctgtgacatggcacatgagccctcaccttctgcttcacatgcctggttttgtcgcccacttgctcttcctgatgaatctgccccagcatccaaatagcacaaacccatgaatattctgtaacccattttcatctttgagcctttgctcctaatctgttacctttgacccctatcctcccagccacccaaattgagcatatcttccaatgcacaactcaagtcccaccgcctctgtgctttctctaactccacagccacacacagcctgtcctctggccttcctcaggtcctaacagttgaggtgggcataaaagaaatgagcagatgaaaataatctgctttgtagccaggcgcagtggctcacgcctgtaatcccagcactttgggaggccgaggtgggcggatcacctgaggtcaggagttcgagactagcctgaccaacatggagaaaccccatctctactaaaaatacaaaattagccgggcgtggtggcgcacgcctgtaatcccagctactcaggaggctgaggcaggagaatcaattgaacccgggaggtggaggttgcagtgagccgagatcacaccattgtactccagcctgggcaacaagagtgaaactctgtctcaaaaataaataaaataaaataaaataaattaaataatctgctttgcaacagacagaactctttcagtaaaatatccagatccggaagctcatttcctgcatattttgtctgcctgatgagcccctcctcatgtacctgcatctctttggtgatcagtcttcaaggcatggggtggaaccaccagtgctcagtctggaactccaatggtgtgattggcaggagcagagatgccacagcctttcaggtcatgggaaggctttttggtggttgttggtgttcttcatgtaggaccctgacaccccttccgtaaatgtaattattgttaaaatgataatccttgagataatggaaagcaacccagtgaggctgtggaacctgcattgaaaattgttgaggtagaacagactgctacaggtgagagagtcttggtttccactcctgtcggcatttggcatttttgcatgtacaaagtctgttccccatcccatgacaaaccccaggtgaatcactggacataaagatggtatggccaaggagaagcaaaacattgcagaccgtctctaccagcagaagctcagcaccagggtgcaactcagatgacagattgtaggtaaacacgtgtgcttactacccattcattcattattcattcatccattaacacgttttgcaaatattctttaagcatccattgagtgctaggcaccagggatttgatgatgggcaaatatagaactaatgatacccagtcagagagagagataagaatcaagtgtaactacataagcaaatgtaaaaatgtaatggggacacactctctgaaacctaggagttggtgggagatgctggtaacagcctctgatagtggggtgtaagccagcaagatcagccaagccccctgaggctctgagatcaaattgaaatccgaaggatgagtagaagatgaagaatggtgaaaagaatgttagaatattctaggcagaaacatgtggccaagtcctgttgggcgggggcagatgagaggaaggaagaggtgggagatgtccctagtcctgcagggcgtggtgtgccacatcttcctagaagcaacgggaacccatggagaggctcttggggtgagggtagagtgaggacaacttcacatttgcacacagggaaaatcctcttctcttcagagtggagaataggcaggaggggagtgagcatggaggtgaatagaacactcagaggccactgtggcccagccggggaaacatgacctgaccattccctgggaagacactgtggcccaggaggacacacacactgtcactgggaggacactgtggcccagacagggacacacagcctgactgttcctaggagaacactgtggcccaggaggagacacacagcctgactatccctgggaggacactgcagcccaggaggggacacacagcctgatcattccctgggaggacactgtggcccaggcagagacacaggcagcctgaaccatgatggtgatggttgagtggagagaaatggacaacgttaagagatactatgatgtaaaatccatgtgtgagccaggagaatagcttcaacttggaggcggacattgcagtgagctgagattgcgccactgcactccagcctgggtgacagagtgagactctgtctcaaaaatataaaaaaatcaaataatacaataaaataaaatccatgtggcaaggtgacccactgattttgggttgttaggaaaagagaggtatcaaggatgactgctaagttctgtgctctggataaaaatgaaactcaactttgaggaaactgtgtactctaaatgtttctgcattggtctcccaggccattccaatcaactgcaaagcttcatctttcataaaacatgaccttaaatgaagacttaactatattctaaagtttgctgtgtacattaaataccatatgtggtgaacatttccaaattccttaactgtgtgacacttcatttgtttttggtttcaaaatggaaatcacaactgtccccaatgtatagagttagattttaaaatttaccaatactaggcaattgcacaaaagatttctagtaatgtccacaggaaattaacatcagcaacacaatttgatgacgtaagagggcttttgcaacatatgatcagttccttcattgttaacattttaaaaacattctgatatcagggctgggcatggtggcttatgcctgtaatcccagcactttgggaggcagaggcgggcagattacttgaggccaggagtttgagaccaacctggccaacatggtgaaccccgtctctactgaaaatacaaaaattagccaggcatggtggcacatacctatgatttcagctacgcaggaggctgaggcaggagaattgcttgaacctgggaggtgaaggttgcagtgagccgagactgtgccactgcactccagcctgggtgacagagtgagactctgtctcaaaataaataaataagtaaataaaaataaataaataaaaacatactgatttcagagtaagcatatcatacacaagaaattacctttatacctcgaatcccttttgatttttagaaaaataagctcagaaaatatgcacttttcttagaatagtctgcaaaaatttaagaagataagagttttctttcagaagacattatacagcctatatattttaaaatagaatatatatctatagaacaggtacatgattttgagcaaatcatgttacctctcttgaccttgccttctttcacaatggatactccaattacgtgttatccaggttcgttttggcttttacgattgtttaattctactttttcaatcccacttcctttacccagtaataatattcattggtgtttttcccttaatcgaagaaaaaaaatgagaaaaaaaaatctcattggtttgggagtctactctgtgacaggctttgagcatgtgtatatatcttattagtaatctcagcacctgtaacacttgtgtagggaatgtttcattttacctattctatcgataaatagcctgatatttaaagaacagagacatttactaacttttctaaagttactggaggcaggatgtaaacatacgaatttctggcttcaaaaccaaaattcttttcctgggtcattagaatcccccatctaccaatacactagtgcccaccctctctctgtggagtcagtaatactttaacttcgtatagcaagcaatgcttcaaagcaacctcacagttttggtcccactaccccttaaaattggaaggcaattcatgttacccacttttgatgaatgagcaactgaagatgatccagcagcagccaccaagtggctgagacacaactagaaccttgtctctctattaaatgcatttcctgatgacacgatgctgaaccttgagactcacaggagattaggcccatggagaagtgggaggaagaggaacaggggaggagaaaccatggccagagttctggggctgaaggaagatgagagggaaggtggagtcctcaccaaatggcatcatgtctgcaaggtgctctttcagaaattccagtaagatccaaaagcatcttgccaatgaaactagaaaccatttgataggttcgatctggacaatttttgtcttatgccagatgtgagttgatgaatgtcaaatgatagtttcagatgtaaacagcagggttcctgaccacagcagaagagcagagaaaggaaggaacccttcagctcacagaatgtgaaaggcatcagtaaataggggagcatcagtgcccatcactgtcaagggattactccaagacacagggattcttcggggggcctttctaatgtcttaacatttaatagaattgaagtgtctttcttcgtacagtattgcaatccatgtagtatgggaactttatcaaactccagaatatgtgacagtggacatgtgatcctattaccaattttttcaggatcgactctacatgggcatcctcagtaggctctgctgtcaaaaatccataattaatgctgttttaacaagtgtcaaggcaaatgtggccatttgtagagaggaataattatttgcttatttttggtggtatgtgatcttcagagtcagagaaagatggggcttacagtcaggtgtcaattgtcagtaacgtgcccttgacttccaggaagttccttatctccttgaatctctcttttacacctagtgaatgggatgacagtttccttcaaccagtttcaaggatccagtcagataatagatggtaaagtgagccctgtgctattggtggcaatgtaaaatggtgcagctgctacagaaaactgtacagagttccgtcaaaaaatcaaaaatagattacaatatgttccaataattccacttctgggtatttctccaagagaagtgaaattatgatgtcaaagagatatctgtactcctaggtttgctgtagcactattcacaatagctgagatgtggagaccacctaaaagtccattgacagatgagtggataaagaaaatgagggacacacacacacacacccctaggaatattaatgggtgttaaaaaaagaaggaaattccgccatatgctacaacaaggatgaacctagaggacattatactaagtgaaataagccaatcacagaaagacagatatgacatgattccacttagatgagagcggaatggtggttgccagggggttgggagaagggaaagtggggagttgctcttcagtgggctgtggttataaagtttgttattgcaaaatgaataaattctaaaaatctgttgtataacattgtgaatatagttaacagtattgaacagtcactgaaaattttaagatagtagatctcatgttatctgtttatatcacaataataatattaataataacaaaagtttcaagcaccatggcagatgtatctaagaggtcttcctcctctcaccctgcccctcactctgctcctctcccctacactgttgacatcctcctggactttactcagcctgcttcacaaggacaggttcagggtgggtaagacttatttggggagattgtcattcaaaactgaaggagtactgagtgccagacactgtcatgatcagagggtggaaacccctgctatttgaatggatcatcaggcaaaatgaggaagtgtcaggaattgccctatgcctgccttttatcctatgattcagagctctcattcactaaagctacaatttatttaacctgctcagaaatttcaggaggaaaatcagtggatgagaaatcaataataatgaataatctcccattcagaaatatcattagagattatttttcattattccactggtaacagcaaatttaaaagatactgttataaactccatagcccaagcttaatagaattaataatcaaatgggatcctgagatcaataattctcaaattgttttttgtactccaggaattcccagtgtgtacttcaaagtgaatctgacacttcattttaaaaacaatttggagtgacttttgtccctatgaatgatgccaaattgatagtttaaaaattgatgggtttaacccaacaatgaagagactgcaactaatcagtccattctttccttctgcaagggtccttggctcatcaaaccatctcgaagtcctcatttaactaattttattacttgatctacaatttatttcaccccagccacaaaatagaccagtacttagggataaaagtagctgacacaaattttgtttcaaataggtcattattttatcttgatatataaatgtcaaagataccgcttgggttcaaatggtgccagaagacagacaaatgggcaggctatcagagagaaatggaaactgggaaagaatctatttctcttcattttagtaagaacctaagatattgtcctaagcttacaattgcagggacagaaggagaatctgaattagcattaaaaatgattttttaataatatatataagggaacttttaaagttcatggaaaagtggacttaaaagataaaattaaaaacattaactttatttctcagtataagctccatcaagttcaaaacactttttaaagcaatgatgtcagtcatttagtccatccctaaagaactgagggtccctggaatttagccatttcaatgtaaccttttttacattattaactgaagaaaaataggtgccctttacagattttgtaagattaggaaacaaaaagaggtcaaatggagccaaatcagtatggtaaggtgaatgcctaatgattttccattaaaactctcacaaaattgcccttgtttgatgagaggagtgagtaggagcattgtcctggtggagaagcactctgtggtgaaggtttcttgggcgttttttttctgctaaagctttggctctctcataataacacattatagttatttggccctccagaaagccaacaagcaaaatgccttgagcatcccaaaaaacttgctcttgattggtccacttttgctctgactggaccacttccacctcttggtagccattgctaaggttgtactttgtgttcaggatggtactggtaaagacatatttcctctcctattgcaattctttgaggaaatgcttcaggatcttgaccctatttgttgaaaatttccattgaaagctctgctcttgtctgcagctaatctgagtgcaagggttttggcacccattgagtggaatgtttattcaactttaatttttccaccagaagttgaagcaattgagatagctatagtgttggcttttgtttttgctgttaattattggtcctcttcacttagagcatgaacaagatgatgtttttcctcacaaattgatgtggatggattaccactgagggcttcatcttcagcatcatcttgtctcctattaaaacaagtttttttatttgtaaactcctgatttttgaggggcatttcttccataaactttttataaagcatcaattattacaccattcttccgtccaagcttcaccataaatttgatgtttgttcttgctgcaattttatcagaattcatgttgctctgatggaggcttttttttcaaactgaggtcttatcttttttaatgcatcaaactagatcctgttcagacatgttataacaaattagtacaagcttatttggtgcaaaatattttgtgaaacccatgcatagttggtttttataatacacattttttcatgaactttttgaagaacttacatataatatttcaatagtggtttatatatattttaaaatgttttagccttataaaaagattagagaaaaaatatttctggtttgggaattgaacatcataaaggaaagttagagtttgcaagatctgaactggccacctgagaagcagctacattatccacatttccttctctgcaccctcctccgcaccctcctccaacccctccctcctatcctctccccatcctcccacacagatatggatctgatggtatgcacgaagcacatggaaaattctgtggaaagacaagaggaataagctatggcccccactcttaataggaagtaggtaaagatttgctctgcaaggaatgataatcaacaaactatttctcagttcttaaaaagaagagataagctagaccttgattagatgcagagaactgtcattagagatgagtttctcttgccttctttccccctgttgctgtgacttcttcatctttaagggactgatgcagcttcatttccacgtgggtcttgtgcctttggattccagctaaaagctcctcccagctgtgaacctgggtcatagcccatgagagccacaagggacttgagtgtcttctggttcaaccacctcattttacagttgaggggctggtgaagggactttcccagtgtccccctgagttagatgtaaagattggggctagcccaaaagctgtctgagcctcagccatctgtcactcattcctggtgcttctctcacctcctcaccaaaagacaaacactgtggtttatccaaaagtggccttgcagattttctgattcatgtctttttgccactcaaaaacattgactgaatgagccctgagtgccggatactgttctaacctatagactactgtgtgaagagtagaattaaagtaaaacaaagacaattataacataaaatcagtccaaactattctacctgtaagtgcataaaatgataatatgcatttttgcatcactgtaaagaaaagtatttcatgtcaccagttccattcagagcactgtaattggcaattacttatttttgacatttgtaagacttcttgaaagatagaatttgaatgctgcatctagtgactgattcttcttgcatattgagctgtttcattattttctactctgctttaaacttgaatcagtatagaaccctcccacattcttgacagggtcctctttactcaagatcttgggatcacaggtttgatctggatcaccctgtctcgtatcttggaaatgatgtctttgacatggatagagatggctagcatgactttgatttgttgtctgtgcctttccttgtggcatgagaggaggctgagaaatactgggctattgtgaatgggaaatgagagttcttacaggcacgctgagcatcccagttttgggcattcagtccaagttttgtgtgaggacatcaggagcctccctaggaatacgagtacttccttcagtgcatcaggcagtatgattagaaccacgatgtaagtgtcaggataacatcgggcatgagagtctgttgctgggtctaatagcataaaacaggaggtggtcacagcaagtataagcactgggaggtgtcggcatggaataataatactggtgcaaggagtgggcttaacatcataactgggaacccagaagccagcaaaatgcaaatcagacaggcaggcagcttctgtctcccttctgtgtctctatgcctgcagtgaagactacctgttgtctctctcctggagcacttgcgagccacagatgagagaggacctttcagtgactgattacagcctaaaggctccaggaaacagccaccactgcgggcttcccccacgtgcttctctgaaaggttgtcagcagtgtattgatgattttcaagtatttgagcatacttgtagcccttgaggtcaaccggcttccttggagatggccattctactctaccagccagggaggaactgtccatggtgctgcttcgcatccagaggctacagggttgccgtgtgataggagccacctgggcagggacttaccctcaaacagcctcgtgtttcatggtgcagcactacagggacaaatgcttacctttgggccagtggagagcaatagcaatcaggacttgggagggaacctaagaggataggacaagctgatagggtgagtggggtgaggtgagatgacaaaggggcaggtactgaacaaaatcaggctatctaacaggcaggcatgctctttaatgggtagggtactatccagtcaagtgtaggccaagaaacagcaatcaagattccttggcccagaaacagggtgtcccagcaaacacaagagcccagaaacagggactctgcaggtaggcacatttggaagctcagggaggcagacttctcctctggagtgatcatctactgatagcaaaatcctagtcaccagggagggctttggtgtcaggacctcaatccctggaaagtagataagtaccatcagaacaagaaactctgtctggattggaatggtgttaagggcatcttgatatgttattcctgcttaagtgactcttaccttccatgaggttggttgtgaatcctagaggctgtgtatggagaaccaatggccctgttagaaagggtggacactgggcagctcatcccacattcagaccctttgcagcaggtctccatgttagcatgttctattttgacaaagccttttgtcctgccaggcatttaatggacttcacacattctacctgcggagctcacatcagggtatctatatctgttcctctagctatatttgtgtttgtatcttgatgctgccaagcatagggaaggcagggagaagccaaaagtcagcagaaaacagctgagataaatgacatacaatgcgggaggaacgcagatggaaatagatggcatgggagtttgaagaagcaaggagccacgaagtgctaaagtctgcaaggaggttctcaagctcatctcactatttatatcacagattacagatttcctgctcgtgtcaaaaataagtcattgccagttgctgtgttttgaagaaagaatcatgcttaaaattatttcacttagaagctcacaaatgaaactgttgactctaaggaataaactgtgtagatagtaagtcttaccagctgtgaattagagtagtttgtgagagtcgaattcagacattttcttttttgagaaaagctggaatagaaagggaagcacttctgccaaggttaacagtaggatgtctttataaattcgatgtagctgtgagggaagggacttctgcaagctttcgtgcatttgctcattcaataataatctgttcatcagtgcagtgacacaaaatatttacagaacacagcatcagtggctaaggagcttataagcaaatgaaatgttaggtgtgttatgtgtgggttaaatggtgcccacccgaaattcatatgttgaagtcctaacccccggtgactgtatttgactaggggtctttaccaaggtaatcaagttaaaatgaggtcattagggtgggtccaatctaatatgactggtgtccttatgaaaagaggaaatttggacacagacacccacagggagaatgccatgtgagatggaggcagagatcatggtgctgttccgacaagccaaggggcaccagagattaccagcaaacccaccaaaaacttggagaagggcataggacagattctcttacacagcctcagaagaaaccaaccctgatgacaccttgatctcagacgtcttgtctccagaaccatgagatgataacttttctgttgtttaagccacctgatctgtaggactttgttacagcagccctagtaaacaaatactttagaaaaagtaaaaagagaagcgaagcaaaacttgcatgcacaacaggtatgatgatgctcatgactacagacagtgagaaaggctgtgggttggattactctggctcagcctcatagaaaaattgaggtgaatgtttaattgagtgtggggttggtctgaagagaaagaatagaaaaggagaatcatatttcatacccttactattcagtcagctatggaaagcatatttggggtggctagaagatgccaagtacagtgctaggtgatgaagcagtgaattaagttaggacaatgtggcccatgtagcctctcaacaggaaggcaggttcagatagaggaaacagcaggaaaaaggtgacaacttgaaaatgagtctcttcctcattcaggtagctttggtgctttgcccactggttgtataagagaatcctgggaaacagcctatgagtagtatttgatatcttgggatgtgggaggtaatcagatttcagtgatgataagacactcccatctctgagctgggtgtttcccagaaaattccaaggacaactggcctttaacatctctctctatggttaacttgctaaacattatccagaaatagccagcaccaacatctccttcaggaccccaacagccaggcattttctccgtagactttgctccaagcctcttatttctgggtttggatcctacctttggacttgaggggcttagatattatcacttaggtggacaaaccatccagttaaacacacacacccacacatacccaacacacacacagacacacacatacacagaatcaacactcaacacgcaaacacccaacacacacatgcacacacactttctgaagatgagttttctcatttatgaaatgagctcatctggacttgccatgagggtccaacaggtgccatgcaatcaggtgtgcactcagtatgggctgggtggagatggccatctcctttcccgtccaggcctggttcctgtgtgctgggcctctgctcttcccacctcacacagcccctgcatggaacagagccggccctgggaggcctgggatccccgtgcctcccttcagcccctcttccaaaatcttgataccggacacacaaaggacacagcagatggccattgtatgatgggttttgttctgttttgttttggtgacagctttattgagatgtagtttttaccatacaatttacccatttaaagcatacaattaaacgttgtttagcctatgcacagaattgtgtaatcatcaccacaatcgattttaggacatttttatcacccccgaaggaaactgtgccccttagcagtcactctgcatcctctgtccccaacccctggcacccaggcatctgtgatcactctgtggatgcacctgttctggtcagctcatccacatggtatcatatcgtgtgtgttttcttcatctgacttcttccctgagcgtcatgttttcaaggctcatccaggtggtagcctgtgacagtgcttcatgcctttctattgtcaaataacgacacagtgttttacaacccctttccacataggttagtatcaccagtgtgcttggatgaattgcagtttgcccagtttgctgttccaaaagctagagaattcctttttttcttttttcctcttactatacaaaccaactctaagtgataattaaaagcgtgagctttgaatttaatcagcactttgttcctttctattgtcaaataactacacagtgttttaaagcccctttccacataggttagtatcaccagtgtgcttggatggattgcgatttgcccagtttgctgttccaaaagctagaatccctgtttttctttttttccccttactgcacaaaccaactcgaagtgataattaaaagtgtgagctttgaatttaatctgcctagattcaaaatttgccatgccatttcttaggtgtattacctgggcaactactaacaccttgttacctcagttttcttatctttattttatttatttatttattttgagacaaagtctcaccctgttgcccaggctggagtgcggtggtgcaatcttggctcactacagcctctgtctcccgggtttaagagattctcttgcctcagtctcccagctatctgggattatgtgcgtgcgccactactcccggctaatttttgtatttgtaataaagatggggtttcaccatgttggccaggctggtctggaattcctgacgtcaggtgatctgcctgccttggcctcccaaagtgctgggattacagatgtgagccactgtgtccagccagttttattatctttaaaatgagattaataataataccaaacctaataggaatgttgttaaatttaataatttggtaagccattaaatcacatgaaactatacctggtacattttaaacacccttaaaagctaaatattatatatcatattctgctttttaatataaataggtcacacaatatatcagcatgcctatagaggcatttcatccttaatgttacttaacacttcaatttattacgaacctaaatggccagaaagctcaggtaaacaatttcccctataattttacgcaacaaaaattgggatttataccaatgatctcaaagtagtttaaattcttaggataatttcttagcccctgatgaaagattctcttcattcttttgaatgatcagtgtaattgtacttctagggaagatatagccgtttatttctcactaaaccatgacctgtgcatgggtgaggcagcccacagtgagcctgaatgtttggccaatccattccttatgtggactcatggaaagcctcagcctataatcagatttaaagaaatctgtagccatatgtgtttccctgacgtcggtattgctgggccatattaaattgctttacatccctaataactttgctttctattgttctctattctgctgcacttacacaaaagctccatggcagagaaattggaaagaccagtaaaaaaataaggaaacaggatattgtgtgtcctggagggtttccccggtgctccccagcctccattgcacaacctccctccacacagccccgccccatcacaatttccaacccctttactcaccccctgtgtctcatccactttcctctctgtcaaaacccacacttagacattctcagagtccttcccattgaggtccaaacaactagtgatggtttaaaatcttacgactgggcgtgagggaaggcccataccttgagataaagctaatttgaagctgatggcaggatttccaacagcagccagaggaggggcagagtttaggggcagtgttttgtcctatagtccttaaacctgccttggatgtggctggttctgacatcttgaataatcccttagtatcttgtttacaggtgatgacacaaacaagttatctggaaataaaatgaagggggaatgaaccaaaccactttaaggtagctacttttaacagttttagggggtcagttcaaaagtctttataactaaattctgaaatacagagtgccctgttttcaccttcaggggtctgacacccagtgttaggtttacagtgtgctgtgggccattcatctgggccccaatgagcttagaaaacaactaagtgaacagcagatcctcagccaggtgcctggccccctgttgacctcacctggggtctcattcactgtcccaccttccctggaccaggcttccccctccactgtccacttaccaaagagtcacaccatttcatctagaaaccctcatctccttcttctttttttctcttttccttctcctccttccagctcctaaaatagaaattaatgtagtcctggcccagcagatgcttcagggatctgcattctgttcctaaatgctcagatactcactaaagacaaatagaagtgttgggtccacagtggatgatccctcagtacatcttgaaataataccttgttaaagaaagaaggtcatatccctgctgaggggagccctgggagcgtgtaagtccatctctgggcagggaagctgaccagagatgcagctgttgacatgcagagagaatgagatgtctgaggacaccctctgccagctcgtgtctgagagaggatcccagggacgtgctggtactgagtttcccctctaagcagaagggaacacttcagattccaggaggacatcgaagatgtctaacggatccttttcctcaccaaagagatgtgttatttggtatttttaataacaccatctgccagtgagaggaaagctccgaattgcaatattgatcttgtcactttggggaacagtttgatatttgggattataaataacattttcatttgctctgttatcatgctcaggcagtgtttgatggctgagcccaagaatattattttcttatcaaatataaagatacgtacttttcctgaggtctgaactctgggttgtgaaataatattgacacatattaaagagtaagatgtattctgaaaccttaacaattcagaaggggtgtaaaatttttctccttaaaaatgaaatcgaggacaatatgaggtgataatagcaataactggctagcgtggattaagaggttaagtcagagtcggattagactgtctgatttaagtaacacgatagcctaacaaggaagcacagcagcactattgttcccatgattcagaccagcaaaccaagatagccactgccacggggctaggaagtagcagagctgggatttgaactcaagcacactggttccagagtccacgctgtgaatcattatactctgtctttatttgcacctacatgggaatggattctcttattattatgctatagataccttcaatatttctttctacatttaaaactattctctcttgatcctcatgaaaattatttgagatacacaggacaaatactactatcccagttttacaagttaaaaacccaaggcccagagacattaaacgattttcctcaatgccatattggaagttaacaacagatcgggcttcaaatataaatcacctcactcaaatacatgtatctctttgatttgagcaacacaaaattattaccattattgtcattattgaaagaaacagttgatccatttgaaagataagctacactgtttgtgcttctgggtggctgggatggtaaaggaaatgcatgtggaggcgtagccagcattttgctagcaagctccacaagaatgttttacctaagttcttaggggaaggggaaaatggtcagggccaattctttcatggtaccgagcttcagacactttctgtccaccatttgtactccctctgatttcccgtatggaattgaggtcttgcattttcaagaaaaatggcaaaacaactccaaaaacatgtctttctagtgtcgtagctcttagtagcttccttatacagttgacccttgaacaacacgggtttgaacggagcagttccacttatatgtggattttcttctgcctctgccacccctgaaacagcaagaccagcccttcctcttcctcctcctcatcctactcaacatgaagatgaggaggataaagatctttatggtgacccacttccacttaatgaataatattttctcttccttaggattttttaataacatttctttcctctagcagtcactttattgtaagatcactttattgtaagatcacagtatacatacacagaaaatgtgtgttcatcgactgtttatatcattggtaaggcttcctgtcagcagtaggctattactagttatgttgtggtgaatcaaaagttacacaagggctgggctgggctcaatggctcatgcctgtaatcccaacagtttgggaggccaaggcaggtggatcacttgaagtcaggagtttgagaccagcctggccaacatggtaaaatcctgtctctactaaaactacaaaaaaaaaaaaaaaagaaaaagaaaagccaggcatggtgtttcacacctgtaatcctagctactgaggtggctgaggcaggagaatcacttgaacccaggaggcggaggttgcagtaagccaagatcgtgccactgcactccagcctgggagacagagtaagatgctgtctttaaaaaaaaaaaaaaaaaaaaaaaaaaaaaaaaaaaaaaaaaaaaaagtgatacaaggattttcagctgctcggaggttcaaggttcaataccttaaacttttgcattgttcaagaactaattgtctatgaattttgtaaaattgttcagagttgtaattattatctttgttgtaggttttaaggaaaaggatcaactcttcgttattttcatctctgtatttagctaagtttatgtccaatggggtaattctaaccatattttaagatactgccagcgtagattgtctctgttaccaccggatgcctctggagaatgctgcatgcatcaaaatcaagcagtaaggatgaaaaaatctgctctttcctgaactgaccagccttccctgactgtgcacactgattttatctcaatacagtccacaggcttttgtctttctatgagcttttccttctataataagaataggaatagaaaatgaccactaagttctccatcttccatcccatgcctcagccaaggcaagaaagagtgaaataactgctaagctattataaataactatctcctgtaaaatcatgaacatagagtgtatgtcagagatgttggaatcctgcatccttaatgtttaatggtgtttcctacaaatgttccctgagtattcccagtttggtgatatagtccaagctgcagagggaaaggatgtaacctgatattcatattcagttttccacctgatttctttggggattcacctcatttcctcaagtcctgctaatgtgtacggtggtaattccagcattctctcctcggaatatcaacaatgacagtttcttaattgctctcagtggattttatgtaggatagacagtgaggtttgaccacttgattcatttgaaatgagcaatacttccaccttgacatgatatcatatacttggtattttcatgatttattggtggcctggaccaatatactttgggtcaaaaggtgtgatttaaggaattcaacctaagaatagtaggccagctcattctcagtcattatgtgatttgttggaatattgtgaagttccgttgataaataaattgatgaaaaccttttttcttaccatgtaaccacatactgctttgcaccaatgattgggcacaaatataaacatattgctgcacagtaggtaattcaatatcaatatgtgtgtgtgtgtgtgtgtgtgtgtgtgtgtgtgtatatatatatagagagagagagagacacttttatccatttaggaagacaaacatattcataactatgttttccattaaagtatgttttccattaaaatgtactaaataggagagtaccttcctgtgtttccctgttttatccaaattctcagtgtttttaaagatcccattctggcaggtcatggtgactcacacctggcgtggaggtgagcacctgtagtcctggctatttgggaggcggaggcaggagaatcgcttgaacccaggagaaggaggttgcagtgagttgtggtcactccactgcactgcagcctgagtaacaaagtgagaccctgtctcaaaacaaaacaaaaaaaagatccaattccatccccatctactccaaaatgcctccctatttattcttatattgattaatgtattcttcctcaaaattatattactttctgactcaatatcatacaaaccggcacttatcacatcttgaaatttcccgaagctaacacgtgtctaacctgtttcccatattatgttttaagtttaaaaagattgtctgccgaccgaaaaagtttatgtcaaaactacagaaaagagccatttcttccatttctctaaaacatagccctgtgtcatctctgcttttccacccacccctaccccaacactcatcctacttaccttcctctggcattcacagagggctgagtttctagtagatgttaatcaaattctttgcatgtgattgctcagtctcttttaacttgaaaaggggaaggcagtgtaatagaacacaggaaggagctgttcataggttcagaagtcactcttggattttcaatatttgtgtttcattccttagaaagtgctgtcagttccctctttgaggagctctctgaaacaacaaagggacctgtcatttgtgcatacccccgactggcacctttgaaatgttatccagtcttgctacctaccatttctgatttgtctgacgttgacatgtacacaccctggagcaggtctgttgacttcactcaggcttatggaatattgcatacatccaccgtactccataaataactaatagtgtgaagcagagatcagatcaactgacagactttgtagaatgtaatctctggtaacactgactttaagaggcaatgagtgtgtgtgtgtgtgtgtatgtgtgtgagtatatatatattcccataggctagcaaatgaaaactgacagtgaacttttcctctagctctgatagagtgactggcattgggcatttcctcctggcataaacaactctaaagctggtaaaatgtgcatgacaaatgttttaaggcattaaacaacaggcagcacagaactgtaattcttgagagaaaggaaacatgagaggtgaggctcagtttgccccagtgctctgcctgggaccgtttcctgcacatctccagcagaactgtggcctcactgacctgaggaggagattggagctgtggtctcagaagcagctgagatttggggagccaagtgcaagagcagaagctgaggacaagggtttccagaagtcttgatgaagactcattgctggtttttggctgaaggctgcccacaccatggcaggcagtacacagggcctagcagtggttgccttctgcagggctgggaatgaatgaaggcattattgctatgcaccaccaggagatgctggagctccagctcagccagaatggagagaactcattgagcatctcagtcaggcattcagttgaaacctcagaaagtccacaccatagcagtaaaagctataccctcaaataagggccacaccttagcccataactagaataagttcatgtccatgaaaggaaagacatgaagcctggtatgaccaaaaagatcagttggtaatttccctgctgccaaaacaaaactcagagcacttctaatttaaaaagagattatctagaatcatgaaaacattttgtctatagtatccagaataaaatttttttaaaaaattgctagagtttcaaagaaacatgaatataagacccatgatcaaggaaaacaacagtcaatagaaacaagccctgagattaaatgcctttgatgttgaaattttcagacaaggattttaaggcagttataaatatagccaaggaattaaaggaaaacatggtcataatgagtaaacagagggaaagttgcagtagagaaattataactgtaaaaaataaaattttagaactgaaaatatgtagtagatgggtataataatagttaagaatggcagaagaggccggggcacagtggctcgtgcctgtaatcccagcactttgggaggccaaggtgggcagatcacgaggtcaggagattgagaccatcctggctaacacactgaaaccccgtctctactaaaagtacaaaaaattagccgggcatggtggcgggtgcctgtagtcccagctactcaggaggctgaggcaggagaatgatgtgaacccaggaggccagagcttgcagtgagccgagatcacgccactgcactccagcctgggcgacagtgcaagactccatctcaaaaaaaaaagaaaagagtggcagaagaaatgctagccaaactgcaggcagatcaagagaattatttgacctgaaaagcagagattaaaaaaaaaatcaaacaaaccgtatctcagtgaactagcaggacagcatccatgtggtcaaaatacatgtaagttgcgtctcaacaggacagaggagagaaaaaaattgtaaaataataaaacttttctaatatttagtgaaaaaaattaaaatgcttattttaaaatttcaagaaaccccactggtataaaaacaaagagaaccactcctatgccccaagataaccaaattactgaaaatctaacccaaagagaaaactgtcaaagcagttagagagaaaagacacgttatatacaaggaaacagttctaattaatagtggatttcttgtaagaagatgcagaataatattttagagtgccaaaagaagaaaaaaatacaaatctattgaccctaaattttatataaagcaaaaatatcctctactgtgggtaaaataaagacattttcagataagtgaaaaacaataaaattaagagtcagcagacctatactgcaagacatattcaaaagaagctttcagaggaaagaaaatgaaaccagaaaatgataattacagtatgacatgaaggataccaaaaatagtaaatatgctaataattagaaaatctatgtgtgtttgtttcttaattttcttgaagacacctgactgtaaaatgtatgacaataacaacatagaggatacaagtaactggaattaaactgttataaatgttttaagtttatgtaaattgatataatattgactgtatataaactatgagtaggtaaggatgcacattgtaatccctagagtaacaaattaaaaaataatgcaaagaggtatatctaaaaacctaataagggaattgaaaatggaaggataaaattctttgattatccccagagaaattagaacaagaggaatagagaaatagagattaaataggatacacagaaatatatgagtataggaaacttaaaactaaacttttcaataatttcactagatgcaaattaattaaacatccccagtgaataatcagttttagatttaaaaattgaagacataactgtatatctaaagggactttttttttttttttttgagttagggtcttgctctatcacccaggctggagtacaatggcacaatcttggctcaccacaacctctgcctcccaggttcaagtgattctcctgcctcagcctcccgagtagctgggcttacaggcatgcaccaccatgcccagctaatttttgtatttttttggtagagatggggtttcaacatgttggccaggctggtcttgaactcctgacctcaagtgatcctcccgcctcggcctcccaaattgctgagattacaggtgtgagccactgcaccaggcctacaagggactcactttaaatacagagacacagataggttgaaaaggaaagaatagtaaaagataaaccataaaacagtaagcataaaaaagctatggctggccaggcatggtggctcaggtctgcaatcccagcacttttggaggccgaggtgggtggatcacctgaggtcaggagtttgagacaagcctggccaacatggtgaaaccctgtctctactaaaaatacaaaaattagccaggcatggtggcgggtggcctataatcccagctacttgggaggctgaggcaggagaattgtttgaacctgggaggtggaggttgcagtgagctgagattgtgccactgcactccaggcctgggcaacaagagtaagactgtctcaaaaaaaaaaaaaaaaagctatggctatgttaatatcagaaaatgtagacttcgagataaggaatgctgttagaggaaaagagagatatctgataataataaaatggttaacttattagaaagatataaacatctatgtatatagtagctgagctttgaaatacctgaagtaaaaaactgacagaactcaataaattcgcagatatttggatattctaacattctcactcagtaactgttagaacaattaggcataatttcagtaagtatatagaataaagaacatagtcattgtgacttaattgacatttacagattactccaataattgcagaatatatatttttaaagtgcaagtagaactcacattatgttgacacataatataacaagtattaaatcttaaagattatgtcctttaaccacaagaaaattaaattagaaatccaaaacaataagatatttagaaaaagcataacatgtttagaaaataagcagtactctcctaactcatgggtcaaagaaagtacaggggtaagttaatacatattttaagctaaactgtaataaaagaacaatatgtcaaggctttctggatacagctaaagtagtgcttgttgagaaattaaagctttcattgtttaaatagggaaaaaaaggataaaatcaattatttaaattttttcttcaagaagttggaaaaagaaatacaaaacctctagaaagtagagaagaaaatgtgaaagaaaaaataaaatagaaaactgacaaataatggtgacaacttacataaatgaagagattcgatattatcaagatatcagttctccagcaattgatttatgggattaatacaaggtcaacgaaaattccaacaaggtggtagaaattgacaagcagattctaaaatttgcataggaattaagtgatcctagaatagctgaaacagtcttgaaaaaaagaacaaatttcaataacttccacaacctattttcaagatttactatgaagttacagcaataaagtgtggcattagcataagaaaagacaaataatcaacggaactcatttctgaagagtccagaattagacatacacatatacaaccattgatttttgataaagtaggaaggcctagatgaaattatggggaaaaatgaactttaacctctacctcacaataattaattttagatggatcatatatctaaatataaaagctaaaactaggaagcatgtggaagaaaataatggaaaatgttacaacttttgtgctggtaaagacttctcaagtagaaccgaaaaagttcctaccataaaaaaattgatcaattggactttatcaagataaaaatttctgctcatcaaaagacattgctaaaatgaatcatcaagggccaggtgcagtggctcacgcctgtaatcccagcattttggggggccgaggtcagcggatcatttgaggtcaggagtttgagaccagcctggccaacatggtgataccccatctctactaaaaatacaaagatgagccaggagtggtggtgtgtgcctgtagtttcagctacatgggaggctgaggcaggagaatcccttaaacctgggaggtggaggttgcagtgagccaagattgcagtactgcactccagcctgggcgacagagtgagactcagtctcaaaaaagaaaaagaatcgtcaagtaacatattagaaaaattatattcaattccatttgtgtgacaaaggacttgtatctacaatatataaatattcctacaaatcaataatttataatggacaaaagacttgaacaggcactttaccaaagaagatatctaaatggtcaataagcacatgaaatggtgcctaaaattattactcaccaggaaatgccagctaaaaccatactgagggaacattttaaaacccactggaatggttataatcaaaaaggttgacagcaccaaatattggcagggatgtaaaacaacacaaacgctcatacattcttggtgggagagagctctacaacaagtacaactacttggataattgtttgaaagtttcttctaaagcccagtatatagtgcccgactgcagtctactgcactcttaggtatttacccaacagcaatgaaaacatgtccatgaaaagacttgtacaggaaagtttatagcagccctactcataataccttcaaactagaaagaagccaggtatctttcaaccagataataaataattgtgatctattcatacagtgaactgttattgtgttagtcggtttgggctgctatataacaaagtgccatagactgggtggcttataaacaaaagaaatgtatttctcaccatttcgtaggctggaagttcgagaccagggtgtcagcatggttgggttctgatgagggccctctaccaggttgtaggctgccttctcacggtgttctcacatggcagaaagagggcaagagagctctctggggcccctttgtaagtgcactcatcccattcacaaaggctccccctccttgatctaacagctttcaaagaccccacctccaaataccatcacaatgggggttaggactttaacctaggaattttgatggggcacaaactttcagaccattaaagtgaacaagaaagaaggctgcgcttctaatacatgtcacagcagggatgagtcttagacgtgaatttcacacctggcatgaaggaagccaggcaaaaaggacgtgctctgtaattcagtatgtaagaagccccagagcagggagagaagtcagaacagtgattattatgggagggtgggggtggaattgacttgtcaggggaaatcacatacattgggaaatgagaaaatgtcttctgtcttaattggaatatatacatttgagggtatgcaccaaatgatcatgtatgtttgtcaaaagtcattgaattaggctgggcgccgtggctcacacctgtaatcccagcactttgggaggccgaggcaggtggatcacttgacatcaggagtctgagagcaatctggccaagatggggaaatcccatctctactaaaaatacaaaagctagccggatgtggtggtgtgcacctgtaattccagctactcaggaggctgcagcaggagaatcgtttgaacccaggagacggaggttgcagtgagccgagattgcgccactgcactccagcctcagcaacagagggagactccgtctcaggaaaaaaaaaaaagaaaaggcattgaactgtacatttaaaatctgtgcatttcaatgtatataaattttacttcaaggaaagaaaaaggggacatgtcttggcatgtgcctcctttcttaagcctattaattataaaactgggttacccagatcctagaatatggctatgaatagggtagctgtaagagccatagataagaatctggggacttacgggtgttgaaaactcacggtggggctgacaatgattataatctgcttttttgttaccatttcagattatgacaaagcactggtgttcatcaggaaactaatgggagtaaagggtaaatagcttagtcaaaaatgcagctctctctttcaacatattagcaggaggccattttctggttttgtgcgtcaagcacaaagacaagcatcctatttgtttttagaaatcacatctaactttctttaggaaaggaactttaattttatagcgaatgaaaaatatcaattaacctattaattaacccggagaaactattagcctgggagataataaaattgcttttgaaaagattacctgacaactgcacaaataattactcttgcaaacatccggtgttctgcctttctctctaagatacttgagagagtttaaatatcaaagaatcctgattatttcatgagtattttcttcagctgttataaaaatcatgcttcagtgtttcagggattttgttttgtgcttgtcttggcagtggggaggaggggagcttttgtgtgattccaggtaaaagtatgctactcacagccttttgtaggtcatggcttcttgagaatgtgtacaatgccacggagcctgtccccagatgcatttccatgtgactatacacatatgcacacaatcttgcatatgatttcagaagcttggtgggctgctagaattttgtctcagatcctctagagtctagatgatggaggctggatgtaagggaggagaccacccttcatactgtcttatgcccaatttctgcctccaaagaaagaagaagtaaaaactaaaaggcagaaatgaaatccacaggcagacagcctggtaccacacccggggcctggtagttaaaaatcaacccctgacctaatcggttatgttatctatagattacagacattgtgaaaatgcactgtgaaaatccctgtcctgttctgttccgttctaattaccggtgcatgcagcccccagtcacataccccctgcttgctcaattgatcacgaccctctcaagcggactcccttagagttgtgagcccttaaaagggacaggaattgctcactcgggagcttggtttttgagacgtgagtcttgctgatgctcccagccgaataaagcccttccttcttcaactcggtgtctgaggggttttgtctgtggctcgtcctgctacagatgggcagccttggttctcatttttcatgccatctcctctaatggaaacaggaatgatctccccatgtcaacacctgcagtgtgggcctgcatttgggagggcgtgtgggtgcgtgcgctggggctggctactggtgtgcattgcccagagagtttatctcagaagtctttgacaaaggcacggttggcttcattttctgtctgtgaattcaagtaggagacaaatggatttccttactttttctgatcctgtgtaggaactgtagaaaaatgggtgtttctccctagttagaaagaaatgcttttcccaaagatgaattcagacagctttatttaatggaaaaaaatgtcttgcctgtttctaaatgcattcttccctggtggcttatacctggcaaagagaaaaattagtctcttgactgaatgaagtccccgtcaagacgaaggaaaagagagaagtgagaaaagaggctagaagagccaggattgaaggcatcgtgctgggggtggggtgcgtgctgagggtaatcgttgcctggaggcacataggctagtccatcagatccaaaattccaaagcttggctgtgtaaagaacaacatctaggagtattgagaagcaatgtgggcagtgctgagattcaaaaggggcgtccctagtcccaaagacgagccccacccaagtgaatggacttcccgaaattatggtacctgtctgagcctcagtttctccatttgtggatgggaataatcacacaaagtattttgcagagcaaatgagaaaatgtttataagagtctggctgactgcgggaatgctgttatttttgagtttctcttcccttaacgatcaagaataattagagacttatagcagcctgggagaaagttatcaaagaaaggtgtactgtatctgcccaaattaacattaggatgtttcacgggagctacttatttcagaggaagagctacagatggtttggaagatgatgagctttggtgaatgctatgctctgagaatgatggaaaaacagatatgggagaaactagcaaagccgtgaagccattaaggaactgaccacctaaaagacagagtcaacaaggctgtgcaggtctcctagggagataagatggcatattagtcagggttctctagagggacagaactaataggatatatgcatatataaaagggagttaattaaggagaactgactcacaccatcacaagataaagtcccacggtgggccatctgcaagttgaggagcaaggaagccagtagtggctcagttcgagtcccaaaacctcaaaagtagggaaaccgacagtgcagccttcagtctgtggccgaaggcccaagagccactggtgtaagtctaagagttcaaaagccaaagaacttggagtctgatgtttgaggacaggaagcatccagcatgggagaaagatgaaggccggaagtctcagcaagtcggcttctcccaccttctcctgcctgccttactgccatgctggcagttgattacatccaatggtgcccacccacattgagggtgggtctacctctcccagtccactgactcaaatgttaatctcctttggcagcaccctcacagacacaccagaaacaatactttgcatccttcattccagtcaagctgacagttaatattaatcatttacagatggaaatagtgtggttcaaataagaacaagagcaccttgtgaaataacatatgtagaagccaaggcttgcaatgtacagtctagcagtggcctttcatggtagagagactcattcttgcataaaaatgaagatattcaattaacacatcctattggttgtattctataacagggtgagcacatttatttacttcagctaaattgaaaatcatggcctcacaatgtcacgtgtgtgtgtgtgtgtgtgtgtgcgcgcatgcgcacggtggtggtggttgtgatgaaatggaggaagaatatttgagataaagctaatctttgataaaattcctcctgttcagtggtgaaccaggattggagacagagaccaggggagctgccttcccaggcaaggagggcatttggtcactcaccttgtttagaactgctggctatgatacgaacacaaagcagactgacccttagtcagatctattattgttttaaattctctatagataatgtactgtcttatttctcacccctgggcagactgatcccaccaccaaccctgttctacctccaccccacactgcctctgggaatagcatatgaacaaatgtcattgttaattcctgatcagttgtggctgtgttatcaaagcaggagaatcattaggatgtatggattatggcagcttaaaaaaacaaaaactacatgagagacttagatttatgcttgcagaatgtccaaatgagttggaaaagtaagactaacaaatctagaataaaagtgaattgtctttgccaatttcactgccccatgggcagagtcaacagcaactactgtcaaaattgttcttgagatccatctgtccctagacataactataaaaaccttaactcatgggaagagtctacgtggcagctcctttgaaagctttccttgctgtttaagagaagtctagtctgccagaataaaaataaaaatttaaaaatctctactaagacaaattagaagataatgcaaggaatattgggtaaacatggaaagaagggctgcctgtaataagcagtaaaataatcttaaacattctgtgcagagtaaacgcatgtatatacaattaattccaaggccaaagggagtgagtgacatagagcgatcacatcattgtctgaggaaccattctctgccaagaaaaaaggcaacagtctcatattcttctctagattagttgactgtgaaaagaaaagagggcaacaagtcagcttcccttagagaggttgttggtgagtgggacatgtgttaatgagacacttcacaccttccctggtaggtacctggagcaggctgaaataagcaaaagtgaatgcaggtgatacaggtgtggggggtgaggggacagtcttccctacctgcaggggaaagcctgtcaagaaagcccttgcagcaagaaggtactcaaattaaataatgcttgatacatactacctacacactaaccttatggattagtatttttaaaagtctcacctttgcatcctgtttgtgagttagaaatgacttgactagacgtgatttcacatatcacgatttttaaaaatatttgcaattttctaagaatatgtatatgactaaacttatatggtataaaccatactggtaaacatgatgatgatgatgaagataatgatgattgatgatgacaatgatgataatgataatgtgctctctagaaaaaggaacaatattccagatattttaacatactgctactgaattagtccattctcacactgtgataactacctgagactggataatttatgaagaaaagaggtttaattgagtcacagatccacaggcttaacaggaagcatggccagggggccttaggaaacacaattatggtgggaggtaaaggggaagcaactgtgtcttcacatggtggcaggtgagagggagagcgagagagagcaagcgcaaagcaggaggtgctgcaaactttaaagcaaccaggtctcatgaaaactcactatcacaagaacggcaagaaggaagtctgtcttgatgattcagtcacctcccgccgggcccctcttctaacgcatagggattacaatttgatgaaatttgggtggggacacacagccaaactgtatcaaccacatttatttatcacagcagctattattatccctgttctatatagatgaagaaatgggggtttaacaaattgcccaagatgatagagctttgcccaatctatccatgtaccatcaaggccatagctttgcccttattttgcttgaagttgaaaatttcttttatattgttgtttgattttgttgtattacaaagccaaatctaaagaatttcactgtaataatatgcatagtaggtgtaattagaggtaggcttactttgtttatttatagatttagtttgcaatttaaaatccatgaagtgatagcatgtgtcatagcccatcatgaatttcgaatgaaaacactgtggctgtactgagcttctgagaaaaatccaagcgggtaagcaggagttctgagatggagatgcacaatcttaattacattagctgcctccttgggctattttgtgtatgtagtggggtgggcagtgggcttggttcttaatgtaatgagtgatttcaccaaggagggagacagggcttgacttgatgtgtatgggtagtaagtggattactagaagacttaagaacagggaggttagaggaaattgtcacattttcactgggttaggaattttaaaacaaaaatacgagcttcaatgagagaaggaacatacatggcctattttaatgatcatgagagcaagagactgtctgaagtaaggttcaattgcaagattcaaaggtaggacaatgagcatgttgaaagctaaggagaggaataagtgtaggaggaatacattattagggaaaaggaaacgcaaattgtatttcctttgcaatttgcaaaggaaaatttgcaaattttccttttgcaaaactaaagagaattgcaaaacgaaagaaaaggagagtgatgaagagaaccacatgggcaaaaaaataaagatgtagacaattctggatgatgttaacaaatgaataaaggcatgtgccagcagtttgcttagggcagctagtctattcagacagagagttacagggtccgtccgaggggtggaggcacaggcggctgtggtggaggggtgctggggctgaggtccagtgagctgcctgcctctgtgtcaagaaagaagaactgaaggtcacattctggaaacagaaatccactttcctaggggcagtgtgaaatgttaaaaggttttatgttatgccagagaggatagttagacaattagagttatctgaaggttgacaaggcagcaggcttagatgaattacactccagcagtgtggagaggaagcgccagtgaaatgtgaaatttggagaggctgagccactcccagcactgggggaaaggaggtggctctttgaattctgcggtgcgggaatggcagagcacacctggaagccaggagggagcaggtgttacccttgaaccaggcagacgtgggggaggcccaggcgtctcatctctcccctcctcctgccctgtgggaagagcatagtccccctctgcctttttctttccttttgtcttcagtccgccctccctgactagtacatggtcggtcaatcctgtcatagaacagaaactagatgtttccagaatttttatgccacagcgcttgaatgttctattgtttcacaatgctttgacacttagaagacaatactacatagtagacacttaaaataataggaaaaattgtctgtcaaataaatgacttagaagacctggttactatgtccaataaatacttggtgttttattttactcacccctcttaacttctccttgtttcaacacctataaaataagaagagtaatatctgcgctctttaccagttttcctgaagaccacatgagataaatatgtgaaaacacactatgaaaagcacaaaatgctttataacctatagcattatttttgtaagaatgaagcaaaactgtaattgtgtctgaaatctaagaatggatagagggaagatatattccactgtagactcgaacatgatttgattaaagtctgactataagaggagaaaccacttcctgatgaattatgagacccaatttaaggaataaattattggattggcttttaaaaaagtccagtagtggccgtaatttatcttgattagtggaaaggtttcataaactacagtgtgcaaaatattgatccatttagtaagtacaccatgcaggggcccctgcagaaggcaggcacctccagctctgcagagggcagcacagtggcccactgccttttatcacagctgtggaaccaaatggaaactggacgccgtcacggaaaacgatcagtctgcatgacgggcgcatggaaaggaagcctgacatttgaaaacacgtttcttccaaatatctttaaagatttctgaaccagagctcacccacctatctgtagcctccaaattatgaacagaatcatgacagaatttgggtttgtttcccagtggctctgccttcttttgttcttaaatattttttccaaactctcagatcataaccaaataacaaaggaagcagctgtgatgctcctacactgtggtaagtcccctttgagaatcgtcattgtggaaaggagagaaacttagattcttgattctcagtaggtcgttcttgatgaacacttgctaaccccaaggcattcatttactggagcaaggttttgtgcatttcagatgtcagcctgagattctggtaagatgttaggaagtgctccagctgggaattgccaccatagttccttctcagcctcactttagagaggtcaagtgcatctagaaaatgccaggctttagagtgacagcatgaaatacccccttgggttcttttttctttttctttttcttcttcttctttttttttttttttggagacagtgtgtcactctgttgcctgggttggaaagcagtggtgtgatcatagctcactgcagcctcaatctcctggactcaaacgatcctcccacctcagcctcctgagtagcatgtgccactatgcccagttaatttttaaaaacatttttttgtagagatgagttcttgctatgttgcccaggctggtctcgtgctcctgcccaaaagggatcttcctgcttgggttctttagcagaattccagaggctattcctacctgttgtaatgaaacttctcgatttgctctcctctccaaccacaccctccccatcagcatcttctcatctgccctctggggatgtggattcccttcggcctatgaaggcaggtctcccatttaggatattcaaaagcggtctggtgcgggtggctcatacctgtaatcccagcactttgggaggctgaggcaggtggatcacctgaggtcaggagttcaagaccagcctggctaacatggcaaaactccatctctactaaaaaatacaaaaaaattagtggttgtggtggcatgtacctgtaatcccagctacttggtaggctgaggcagaagaattttctgaacctgggaggcagagattgcagtgagccaagatggcgccactgcactccagcctgggcaacaagagtgaaaactccatttcaaaaataaacaaataaataaataataaacagaatatgcaaattcaactccaaacccaaatgaggaaggccatcaaataagatagaaggtaatggttcccactatttgagtaagacagccacatggggacaaatggcttgtgcaatttagtggagtaaatggcacggccacatgaccttgtttggcttctgttggttagcagagatccttggcatcagccagatccatttgttttcttgaatcttagcttttcctctcctttgtccccaaatatcaaagggcaaaccacttgacatcatttctagctgtcatttcccaatgcagtagttttaaagcctgaaaagccaaaggcaccactagaaattacatatattgtggggcaacacgtggaacttaaagaaagtgagcatgaggaggagaggagagatgaggcgaggcgaggggaggggaggcgaggggaggggaggggaggagaggatgaattgctgccaggtgctgccccacttttcatacctatccaagtgactcttccagattctaagtacattcagattgtgttttagtgaaatgcagtaaaacaaacagatgttaaattgctttcatacatatcttgttttatccccataacaattcagtttctggctttatcatacctgtttgagagatgaaaaaacaagactcagtgagatttatgctccccaccaaaaatcacagcaaattcaccacagaacctgaacagtaactgagatcccgtggaaggagagcagaccagggaggctgacgttgttataggagtgtgtgcattttacctattagttcaaggggttttgttggtgttttatcatgctccacaaccaatagcaaaagcaacaaataaatggtataggacagtgcaaaggaataggatcatacccaagtgcgttttaacaaaataagtaaacaatcagtaaaatgtatctgggagtgctggctccctcagggcccctggaacaggggtgcatagttaagaaatatacagagttctgctctaagaaaacgtgtattccttaaaaaccaccacattatacaaaatcacaccaataaaaacacaacagtaatgagagaaatggggttatggacacaacatttaaatatgttgtcagtgaaaaataaaaggaacatagtaaaaatcggtagcatagtttcacacaagttatatggttaagaaatacattgaaactacaagatatatggcacttcaccttgaaaaaagccccagagttcactcggaggagtaagagctgaaaaggctatagttgtgagtgtttgggaagaggtagaagcaaaggtgttgaaatcggacggaagtaacaccagacatggatgcgtgtggcctgtcacacgcggagaacccaggcagtggcagcttgatggtgtgcagccatgtgttttatgaatttctacagactcaattcctgggctgcaagcagtttttctgcattcacttagtgcttctcccagaccaaatcacacatatgcgaacaggaaattaacctgatgctcaaattgttctctaatctatcaattacattgaaacaaagtcacattttcaaagcaagcattttaacagaagtgactgcacctaggtcctccctctacggagcttacagtctccttcagaataaaatatggacaaataggaaatactggattcgtaagtgccaaactaatatgcaggtgttttggaaagggaggggccgctggggcagtcaaagaagtttgttgcaagaggcaattccggaagaaatgacctaagcaaagtcagagaagtggaggtaattgtgatgggagaaaagagaggaagaggtagaggacagagaggacagctgctcaggggtgaatgagaaacaggtttgagcagaagctgggctggctgtgataaatactgaggaatgtcactggaatgtcactgcaaaggaggtgttttttaatgtttgggtgtaaatcaagtctgtagcacagactgagggaatgaatattttacagaattgctgtcatcgttctgtatcttacagcccattctgttcatttctcattcaataatatttattgagtttctgttgtatgccaaacgcgttcacaactgtggattcagctgtgaacacaacgggtgaagcatctaccgtaaggagtggacatcctagcagagcaggcacgtggctgctggttaaggagacgggcacccagtgagctcaaaaagcagccagggctgcggcatgaggcagaatcaggagtcagggaaggatgagccgtggaggaagatggctgtctcagagagggtggccagagaggtcctctctagagaattgacatgtgaatcccgaggtgcccaaaaggagtgggagcaggtctcaaaaagttggtcccaggcaggggaagcaatggatggaaaaatctgacatgtggagaggcagccacaagtctgtggggtgggagcggtaggagaggatgtgggctggagtccatgggtaggagttggggctttatcctcagttccgtggaaagctgccaggtcatgttgagcaggagtgtgttgtgatcggattcactttttaaaaaattattttatttccataggttattggggaacaggtagtggttggttacacaagtaagttctttagtggttattcgtgggattttggtgcacctatcgcccaagcagtatacactgcactcaatttatagtcttttattcctcacccctttccactctttcctcctgagtccccaaagtccgttgtgccattgtgtcattcttatgcctttgcatcctcatagcttagctcccatttatgagtgagaacatatgatggttagttttccattcctgagttacttcatctagaataatagtctccaatctcacctaggttgctacaaatgccattaattcattccttttttatggctgagtagtattccttcgtatatatatataatacatatatatgtataatatatattatatatattatgtatatataaaatacatatatatgtataatatatatattatatatattcttgcaattgtgaattgtgctgctataaacatgtgtgtgcaggtatctttttcatataattacttattttcttcttggtaaatacctagtagtgggattgctagatcaaatggtagttcttttggtgtattttgttgtttgtttgtttgtttagatggagtctcactctgttgcccaggctggagtgcaatggtgtgatctcagctcaccgtaatctccgcctcctgggttcaagtgattctcctgcctcagcctcccaagtagttggaactgcaggcacatgccaccacgcctgggtaatttttgtatttttagtagagacagggtttcaccgtattggccaggctggtcttgaactcctgaccttgtgttccgcctgcctcagcctcccaaagtgctgggattacaggcatgagctgccacgcccagccaattcttttagttttttaaggaatctccacactgttttccatagtggttgcactagtttacattttcaccagcagtgtagaagtattcccagttcactgcatgcacgccaacatttatttgctgggataattggcaagctacatgtaggagaacgaaactggatcctcatctctcaccttatacagaaatcaattcaagatggatcaaggacttaagtctaagacctgaaactataaaaattctagaagataacatcataaaaacccttctagacattggcttaggcaagaatttcatgactaagaacccaaaagtaagtgcaataaaaacaaagattaatagctgggacttaattaaactaaagagcttttgcggggcaaaaggtaaggtcagcagaataaacagaaaacccacagagtgggggaaaatcttcacaatctatacatctgacagaggactaatatccagactctacaatgaactcaaacaaattagcaagaaaaaaacaaacaatcccatcgaaaagtgagctaaggacatgaatagacaattcccaaaagaagatatacaaatggccaacaaacatatgaaaaaatgctcaacatcattaatgatcagggaaatgcaaatcaaaactacaatgagataccatcttactcctgcaagaatgattcacattttttaaaagataattttgcttatacttggagaagctctaggggaaaaaactggaaacacaaagaggaggtatgggagagttgatggtggcttggacctgggtggtggatgtaagcagggaaggaaggaaggaagggagggagagagggagagagggagagagggaggaaggagaaagaagagagctggattcagtgttttgaagttaaagcccacagggtgcactaatagactgctcgtgaaatatgaaggaaagtgaaaattgaggataacttcagctctgcccccttccccagaactgagtagatggagatctaatttactgcgatgtggatgactgggagggcggagtgttgtgtggactccccaccccagattcatatgttgaagagctaattggttgtgaggacctcagaatgtgactgtctctgcaaatcgggcctttaaagaggtaattaggttaaaatgaggccatagaggtggaacttactctaatatgactggtgtccttatgagaagagaacatttggacccacagtgagacaccaggaatgcactgccacagagaaaagatcatgtgaggacacagtgagaaggtgccgtctgcaagccagggagagaggcctcagaggaatccagcccagccggctccttgatctcgggctttcggcctccagaactgtgagaaaataaactcctgttacttaagccactaagtttgtggaaagagagaactcaagggggctttattttaaatatgttagaaagtgtcaaatgaagttcaaaaaaaaaaaaaaaaagactagagactctaggttaagcttacataagagacccaaggacagcaaatcattttgttggggataaaagtgatatttgtaggcaataatgcagcttctctgattttgtactaaatacgttttagtaatttttttgtggcccagctgaggatagcttctcgagatacccttatggtttaactgtatttttcacgcactgttactggctaaggtcagtggatcaaagagacacagtagtctatgcacgtttccgatttattaggttacgacagtggggaaactttctccttagtctagtccatgaatctgctcaccaatgaaaaggaaatatagctaggaattatagcgttactgactccgtaatacttcaataaaatctgttcccagtttgagaaggagtcgggcaaacacaggaacttgcttaaggaaaataaccatgatatagataaccaacagaaagtctagagtaagaaacctaccccactccctttctagcagtgattgcctattacaggagaaaacagattggaagaacaaaggggaaagactcaacagaaactgtaatgtgacatagcttagtctcctgaaaggagcaaagaaaatcagctcaggagtaaatcaggatctctcttctcttgccaggacaaattcttcacttttaagatcaagattagggagctgattagaacaggttagcttctgtttatatatgagcagtttttaattccatagccattttagaagaaaaatctgagtaatcatcgcctcaatgacagaagctagatcaacctcccacaagctgcagctttagaatattggatggaaggaaattgatcctgagatgtggaatcccacaatattttcactaacaggtttccatgagaagtgggtgcttcattcattcttgtctacacacctatttctgcacttcctcctacaatatctcttttgagccagcctcagaccaaacacgactgcattccaaacagtcctctgttatgttctttttattattattattattattatttttgagacaaagtctcactctgtcacccaggctggagtgcaatggcacgatctcggctccctgcaagctctgcaacctaccaggttcaagtgattctcctgcctcagcctcctgagtagctgggattacaggtgcccactaccacacacggctaatttttgtatttttagtagatatgaggtttcgccatgtttgccaggctggtcttgaactcccgacctcaggtaatccacctgcctcagtctcccaaagtgctgaaattataggcgtgagccactgcacccaaccttgttatgttcttttcttggaggtctgtgggaactggtatgaaggtggtacactataaagaaaataacttacatggccaactagagttctgaaaaaccctcttctttaacacaattaaagctcattaaggttatgttgtgctgcaaagtggccttttcaaagagtgtgagaggtgcattttattcacatatatttgcactgagttcaagtatccctaattctcattatgtgtaatgcatttactgtgaaaagacatagaatattgaaaccacaacatgacatgcatacaattcataacaaagctttcaagctatgaaatatttcatggtaggacagagaagcacactccgagttctttgtagtagagttatttggtgtcacataacgattaagaacaatggctccagtcacaaaggcttgagtttaatccttgctcaacttttaattggctgttactttggacaattactctctcttaagcctatttccacttgaaaaaaatgggtaataacaatgtctgtcttgtaggattactgtaaagatgaaaattgtattatcaaaagctgagtatagtgcttggtatagagtgaagagggcccgcattggtatctgtgatgatgatggtggtgatggtgatgatgatgttaatgatgttaatgatgatagtgataatgatggtgatcctgatgatggtgttgatgatgatggtgataatggtgatgataatgatagtgatagtgacaatggtgttaatgatgttaatgatgatagtgataatgatgatgatcctgatgatggtgttgatgctggtgataatggtgttgataatgatagtgatagtgatgatggtgttaatgatgatagtgataatgatggtgatcctgatgatggtgataatggtgatgataatgatagtgatagtgatgatggtgttaatgatgttaatgatgatagtgataatgatggtgatcctgatgatggtgttgatgatgatggtgataatggtgatgataatgatagtgatagtgatgatggtgttaatggtgatggtgataatgatggtgatcatgatggtgttaatggtgatgatgatggtgatgatgatggtgatgataatgatagtgatagtgatgatggtgttaatggtgatggtgataatgatggtgatggtgataatgatggtgatgataatgatagtgatagtgatgatggtgttaatggtgatgatgataatgatggtgacagtgatgatgttgatggtgttaatggcgatgatgatgatggtcataatgatgatgatggtgatgcttctgatgctgataatgttaaactgaaccaagtctctctgaaatgaaatgtggtgcagccttcttagatcattgggcaaaaagaaggcctctcaggacatgtttctgctgtagcttgtgccactcaagtccttgggatgctttgtaataagaaatgaaagttagctgaatgtattttacagaaatgcaccgtttaatactcccttacataatgcaggatcaggagatatagaagtagacaatcatgttgtaacttttaataaattgttcaatcatagtattcaatgctgctgcaccattgattgtattagcaagcatcaaaaaaatccttaaatgataatgtagccgacttacacaaaataaacttaagattactgttttggtcaaagaattttcttgggtcagtagagggagatgaggaaaagaaaaatattttattatattgtagtatattaaataggttttattgtatttctttttaaaaaaatatacaagtgagtattctctcaaaccttagactttttcaccctggcctttcattgttacttgactggctgttactttggtcctatttttaactagcaaaagatcagacaaaataaagggaagaaaagacaattatctaaaaatgcaacatgtacaactgcacagtctagaaataacttgggtgtccacatgtgaggtaagcatctggaactagcaaaccatggtgagacattgtagactcatccccctcccattatggacttgacctcccatcccatgctcctggagatctggtctatgatgagatttctctcatatctctatgagagatactgttgtcgtttccttctgagtatctataggtgattaactaaaccgatcagactgggaactcctccagtgctacactgtgtacactggttgaataaatgaatgaacatataaaagaacaaatgaaaccatatcaggggtgtcctcaatttggggagatgcttgaaatcaatctgtcttatgaaggaactaggaagggttacagtcttattcaccaagatctggcgcaggctttgaaagaagggacacctgacctcaggtgatccgccagccttggcctcccaaagtgaccccatctctactaaaaatacaaaaattagctgggtgtggtggtgcacacctgtaatcccagctactcgggaagctgaggcatgagaatcacttgaacctgggaggcagaggttgcagtgagtggagattaagccattgcactccagcctgggtgacagagcgagattctgtcccaaataaaggacaaagaagaatatttgttcattctgtacacttggccagagatgtttttgactgaaattcattggttaactaacagtgcttactgggttttatcacataagttcatataaatcaatcaatatgattacatatctgttcaatgaaatgattccaccagaggttctcaaagtgtatctgaggaccctgggggtacccagcacctttcttaggacatctagaaagtcaaaactattttcataatgatatcaagatgttatttgccttttgtactttcattctctcatgagtatgaaaaattaatcaatttggtttcagagtgcacattacaactaaccttgtcaggttttgatatagtatcaaataaaaatattcgcagttatctgataaagcaattaaaacatcctccttttccaactacatatttttgtgagactagatttcttttatatacttaaaccaagagtaatatattgcaacaaattgaaagcaaaagcagatgttggaatctggctgttttctattgttttccttcttctattaaagtcaaggttactaagatttgtagaaatctaaaacaatgccactctgctcaccaaatttttttgaaaataattttgcataaaatgtgctgattatagtaagatataatagattttcattttgaatacttaaatattcaacattttttcattttattattgtaaatatacaataattcacaataatatattacaatatataatatatatttacaataaaattatatatttactgtaacaaattatatatatatttatcccttatatatattttatatatatcccttatacacatatacatatacatgcacatacatatataatgtgtgtatatatttatctcttataaacacatacacatgtgtacacacacacatatatgcacacatacttatatatgcgtgtacatatttatcccttataaacacatatacacacatgtacacacacatatgtgcacatacatatatatgtgcatgtatatatcccttacatatacacacatatacatgcacacatatatgcacacatacatatatatgtgtgtgtatatatttatcccttataaacacatatacacacgtatatgcacacatacatatatatgtgtgtgtatatatttatcccttataaacacatatacacacgtatatgcacacatacatatatatgtgtgtgtatatatttatcccttataaacacatatacacacgtatatgcacacatacatatatatgtgtgtgtatatatttatcccttataaacacatatacacacgtatatgcacacatacatatttatgtgtgtgtatatatttatcccttataaacacatatacacacgtatatgcgcacatacatatttatgtgcatgtatatatttatcccttacgaacaaaagctctttggggtcctcaatagcttctaaaggtgcaaagggtttctgagaccaacatgtctgaaagccactgaattaccttaacagctcctaggtctgaaagtttatggttctaaaaaatgcccagcacttgctgtttctatgaggaataaaagtgattgtctcaccatcaacactgtctacaacactgttagggagacaaagcttatctacatcaacatgatggattagctacttttcttagttctttctagctcccacaacaaaataccgtaaactgggtggcttataaacaagagaaatgtattgctcacggttctggaacttggaagtccaagatcaaagtggaaacagattcagcatctggtgagggcccgttcctcattgacagtcatcttgctgtattctcatatggtggatgggactagaggtctccctctgggatttcctttataagggcattaatcctattcaggaggtaacattcatgacctaaccccttccggaggccttgcctcctaacaccatcacattgaaggttaggattctgacatagggattttggatggatgcatgcattcagaccacagtgacagcctacaatcaagttctaaattgtgtagttcaaactaggagaactgtgaggagatggttttggggaaagtgacttctgcatttgcctcaatgattttccctgcgatgacacgtggcctgctctgaacagtgtttgttccacaaaatgctgctgtcctttattcagaaactttctattgaaaccaatttttatctcaataacctgatttttaatctcacaaaactggacctggtgactttgaattactatattagaaccttgtaaattgccttgtttactgattgttttaacacaagatcctgtcatctcactagactatgtaaatttgcagataaaaatgcccatcttagattggtcagcctgggggtgaaaatggactcaaccacttctatctattgattaaaggactctgagtaagtctcctaagtatatgtttttttttcaatctgtaatatcaggatgttagctgtcatttttaagcccctgtgatatcccatgtgatccaaaagacactttgtataattcatcaattctcaaaacaacatgctgagataacgtaattttcattctctataaatggggaaaccgaagatcaaagaattgaatcatggctaaaaccacacaactggtaagtggaaaggagttccacttaaattgaacttataactttgatctaagctgtctgattctaaagctagtgattattttcctattattttgatggtcagctcttaagagttcttgcaatagttgaataaagtgaagcctgtgatagcctagtgcgatgtcaggtacgtagtcagtggtcactcagccttggttccccttgtcctgcccttctcctgggccacagtgctttgtagagctgtattgtaccatcccagtaggtttagccacacagagcccatgagaacaagctttgcacttagatatgctgtccatgtatttgacaattgatttgctgtcctgactttgctattacctatcctcctgatcatggacaagttcctccgcttctctgggctttggctttcttttctgtaaaaggatgaatttggacaagattaccatcagatctatagattttctaccttatagatctgtactattgctgagatttttgtgacaagcttaggagttccccaaaataatgaaactgtgctatttgaacattttctctgaatctcagaggtacaaatttggaaatctacattgtcattaaggaaatgtgatgtataagaaaaacagtaaagtatagctgccgtataccgtacttcttaggtataaaattcatgctataaaatgactttcttcatctggtgtcaaaccctaaataatgggaaataatgcaaaggaaatatgtttcctgatagtcaatagaaggaatgacggacccagcagccatgtgagggtatatttaaactaagaccttcatttcatgcttctcatgattctaattctcattttcccatcgagttaaagggggaggattgagtttaacatgtgggaagagtaagatgccttggttcttccattgttagttttccatattcaccatgttgtataatcattaagcgtatttaatcgtggttattgagttaaaaatgaagtgttaccacccggttttgcagcatgtgccgtaattgttaatctggttatgccaggttgctatgcataaacaatgtctcacatcaatttagaaaatatgatcattactgtttatgaactgataatatagaaaaaaccatttagaatggatagaaggaaaatatcatttttctaaagaaaagcaaaagaaaacatgtcgttggcagagtaacaacatgaatcatagaatctagaagctcgtaagggtctgagaaaccatgggctccagctcaccaagtaccagaatgtgaagtgatgtgtccaggtgccatgtcccccagaggatgctcaggtctaaggctgaaatggccaatctgttcagaagcacatgggtctcctttcctaataaaggaagtagctaagatccacccttaaggcggcaaagtgtgtactaaggcatcaaaaggacaagtcaggtagtgagtaggtcacttattaccagactcaataccagtagctcctgcagaacaggggatgacttttcctctgaaaacaagagtacaagtgcctggtctctgggtgtgcctatggggaaattctgccctggttctggggctcagtctgattccaaagcacacagtcctaagaatggggctttccacgcctcagcccctgtgtcttcccccttcacctcctacaacactgccccagtccgtgtgggtcaactctcctttttctcaaaagccttcacttctaaaagcaaggttgtttattaagttaagtgacaaagagatactgcaacaataataagctgtgatcaaagactgggttgatgttccacatcacaagcactttcattggaagtttctaggattccaggatgtctgtttctgtgaatcccactcagaagactgtgtcttcattaatcagagagaagacaatgcaaaattttaagctctggtaatagtctatgtaaactgactattgtccatttattttgtctctactgagtttaaagattcagtgataccccatttatgtgtcgatccaatcagacaggtaccagaggtgtctctctctggggtagcaaactcagaggggacaaaaatgacagctctactattggttgtggttgcgaacacatatattgttgcaaagaggaagagcctattgaaatcagacgtgggcaggtgttgagttctactgtgatttgctattttccatcatacagagcaaggacaaccagaactgcaaagacagaggccagcagtggtaatgaggactgaagagaagtcccagcatggacaggaggcccttatcatttttaaacagcacaattccctccatcttacctttggcactggagataaatgaaataggctgttctgtttgaaaagagtgtacctgctcagtgggaccagcaagcaccatgtggccatactgtgacagtcatcaaaagaaagagtgcaccttcctttgcagtgataagggggtcacagagaaagcctgggggtcaaagctagatacaaggcatcaggctgccactctcatccagggacacaaacattcttgtctccaatattggatctgaaagtaaaatcaacatattctgaaggaaaaggatccagtgaaggaggacagtattattcagggaggccttgctatacctttatctccggggtttcctgccttacaggaagatgttgccttatagaaagatttatgaatgagatgctttgatgaaagtctgtaaccaaaactcttagctatgtggatggataactatagccagcttcctggtttcaaggaaaaagttctcaaaactctctctacattttgcatcctgaaataatcaatgtatctacctccctggatagacaattagcttcttgagaacaagtaccctgaattgttcactttcaattccctggctgccagcacagtgccttgaactgaactgagcttctacctaagcatctgtatcttctgctaaaagagacctgcctgctccatccatttttaacaggactctttcctaatatttgcttttaattaaatggaatattcatcaaagtgaaaaacatgcttcacttagtacattacctcagactacagagaacacacctctgttacttcttatggtccttttgggacagctgtggatttagtttcatagactttattagcataattgaaaaagacaatccgaggggaagcattttgtgcaccgcctggatggaaattatatgaaggtggcattaccagtactgtacttgctactaaaatttcacctaaagactcattgcaaagcacttgggcaaattttccttttctcacttggaattcaattttgaaaattgggggatgtcaagaatttcactgaatgaggttcatttttaaaatcccattatgagagggcagtgtagggggactccattagccccaggagtgttgaggggaaacgtaaatgagtgaggccattaaagtccttagaccacgggggcctcaatagagcctgagatggctgctgaggaggtggagacatggtcatgataaggactgactcccagcccagaggatgatgagctggtgcgtgttctcatgctgtgtcaaacctccttgcatatcaatcttctgttcaccctcacagccaatcctgaaatccatcctgtctccacatctgtggagtttcctgttgcatggagctcctcacaaaagtctactttccaagacagctttccccaacccagaatgacagtgggattcacacattatcaagaaaagtcacccatttcattttgttcccactggagtctcttttatcacttccctcacaaatgattctggggatatttaaactaattttctagtgtagaagaatttaatggatgtgtggacaccatgaatacagctgctgctcagtgcctgtacttgcttttgtccccaggaattgatttgagtgcaatcaatttgcaattcccaataatgtagagagctgcctctttgtctcagcatctgtcctgctaactgtgaggcccgacactatggtgaaggaggcagaataggaaaggaagagcttctggcatgagagacagaaaaagcttcagatggaggatcaggaccacaggcacacatcccctaaagatcatggaaataatgacaaaatacaacctgcgttacagccagctcccctagcaaggtgtttattctgtgcaacaagacacgcttactctcaccattaggatcatcattagctttaaaattgtcaagtgacaattacccatatattgcggtgatacactttttatactgaagcaaaatacagtcttatggatgggttattttctgtgtaacaatgcacatcattctgcaagatgaccaaacaggagagaaaacaattcacgttctgtagattacttgattgtgccccattttgttaatgggcagtatattttaaactacaatttcaaagtcaaatgtctgcattggttgtttctttaagtgtaaagagatcagaaaaaaagggtttattccttagaatgagtttccctgagatgtagcgaggacattatagtcagactggcacaagcaaagaaacagttacagcagcaccaacaattaggagaaaaattggactccaagtgaaacaatgctaggcgtctcactataaatgctatcaacactttgtgtgagacaggtgcagagtgtgaaagcaatcattcgtacagataatcactgtatcaaatgcgtgtccctgcctggactgcacctgccacaccttttcataaagccaggaagccagacaacagtgtcttgttgagggttggctgtaccatatgggaactgtgagccctgcaccagcatcaggtggtgcttctgttatttgctctctcactgatttagaggagtcctgagaaattgaggtcctcaacagaaaacacatgggtcagtgttaattcatctccagtgacctttgctgctgtggaattctgtagtcctgtctctgttccttcttttatccaaggcttctcattgcaaaatggaaaccgtattgtcaggttctaagttctgagcagcattttgattgggattctatagttcctcagtcatatcactattcttatcatggtgataccaatacaattattacaaatgcaaatacaacccccagttttcctgcaatagaatatgtgagccatttcacactggagttgatctacataaagtcagctgattctaagagctcagatccatacacccgcccctgcctgtcaacatggccactgaccacgctaacacgctgacgaggtgagtccttcacctcttggcaaccagaagtgttagaccttgaattttagcatttgctgaatggagatgcttccatgcactttagaagatttgattcttctgcaagaagaattctcctgttaaatatgcaaaatacgttttttttcttgttctttggcactagttaccaaaatctgcaagtctgtctatttttaatgtaccttcttttaaaagcactgcagtgcctatgtgtatattaggctctaaacctggctctgggaggtcatgagtataattttagacctagcaagttctgaagtcactgtttctcttgtatttcacaatgaaatgtcaggaataattttttgaaaatgaagtggaaccttcttttaaatacgagcccttcatctccatcactcctcccaggctctgtcataatcacaggccgggagctacatttctggctgatgggatccttgtgcagttggcacaggctctgcccccatgcctctggaccctcagctgtccttgcacacctgctgcaggtgcactgtcatgctcagggcagcacctgtgtcctttcattggcacttccggcacgctgccagagctcttactgcccgcctggcctggtggctggaaatgcctggggattttgcccctttgggcagcctcagccaaggactgccagatgtggggaaatatattccagcctcctttccccagcagcagctctgaaggatggcctacctgctcctagagtcctctgcagggctgaggcacagttctacctgtgtgacctccttccctctgtgtcccctccccatgggtttcccttgaaacacatcttataaaatcacttacctagaatacacatttaagcctccttctcataacccaacaccttggcccaaagagcggaacaaagagccggaaccctggggagttgtagcctatggacaccaggtctcggggcctctcctttaaggatatctcttttttccaaacagagtttaaagatgtccttgttccaaattgagaagacaaaaagcaaactatgttgcaggttttccaaatgatttcagaccagatttacaatggcttgctctttaaaaattgaagaaattcacccctggtatgccaggagcctgggagtctgcaccaggattgtcccctgcagatgtgaggacagtttaatcagctccctcctcagtgctccatactctgtgagacgttgtggggaaggcagcatttaaatctacaaataaaagtactggatccctcaagaggaggagagagtggtacaaccttaatggccttaaaggccaagaacttaatggccaagaagccagacatggagatatccatggccattctcaccccactctttccttcccactgcaccagcccctccggctccaaatcaaatagctctgaattcagaatgcaatttgaaaacttgggaatcaaggctcttctctgtggatcttgtatttgagatagtaagaccttgccagtgccttgaagttatctatttaacctagcatagccgtcactttggaagagtgaggccagcactccaggctacgctgtgcatgagaatgaggacaattttgctaaaacaatacaatgcttctttactgagggtgggtctattttgttttaagcttatggatattatcttacaaatacctgttaaaaccccatgcgtagttaataatcccattttagaaaaaaagccactttgacattgaattgctaactgatttttcccaaggtcaccccagtaaaagtgtcagattctgaaatcagattctgtgctacttgatgttaatgccccgtaggcctctcaatcataaaatgccttagagtcacagtgggtgtgacatacgtgaagttgaggaaagaacatttcccttttgacagccagaatagaatcgtttagcaaatggcattgataaggtcaataattcaaatgggaaattagagtattattctgacctcacaatagaattgattaggaaatggcaatgataaggtcaagaatgcaaatgggaaattaagagtgttattctgacctctagggtagagaatgggacctctgctcagctttaagtgaggagcaagacagaatagtgatggtgagccctggagatgcagtcagttcttgctgttcacagtagtcatgctctataaggttgccacaaaggcagaattaactaatactgagctgttgctcctagtggaaatgtaaggttaggttccttcaagcctcgggtcacaacattttcatccacagatccacacataagtttcttaagtgagcatttctgtttaaaaacattgtattacatatatagtcttcattcattaacactgatttcatggccaacggtactataacacatgcctgcatgaagcttttccaacacacatattcttctccataaggcacatcacggtattcttgtgcttgggaaccctacacagcacttcagcacgcacttgggggccattttaaacagcaaaatcaccaacaaaaaatacaaaaatgtggaactaaatagaccatgaagaggacacttgtttatagtatgagctaaagcaagaaggcagagtgccgtcatgttcagacccagctaggaacatgtgtgtcaggcaactcacttttttttccactgtgtacatgactgcaaaagacctggaaagcaccatgagtattgatttgcaagttacacataaattttaggagtaggtcgatctgcaaatattgcatccatgaataataaggatcacctctgttagcattagcacattgcccattgacaaatctactggattcatctgagctagtaaaaacaacaacaacaaaaaaaacaattgtcaatcagaccaaaggtaatctccattcgtacacaaatagaaggaacaattagcttgggaagatctgcctgtttatttaattaaaaataaattttaaaagatggaaggctgggcatggaggctcacgcctgtaatcccagcactttgggaggctgaggtgggcagatcacttcaggtcaggagttcgagaccagcctggccaacatggtgaaaccccatctctactaaaaatacaaaagattagccaggcatggtggctcatgcctgcaatcccagctacttgggaggctgaggcaggagaattgcttgagcctgggaggcagaggttgcagtgagccaggatcacagcactgtgctctaacttgggccatagggtgagattctgtctccaaaaataaaaaactaaaagaaggagaagaggaaagtagtcttctctctcttgctccagcagttctgaatcacctttgtgtagtttcttgatgttcttgcttttcctgtgcaaatgggtagtgaccttaacagtgcatactgtgctgaaactctccccagtgagagttcttccacatattctgagccatgctgaataatcaggcaggtgcacggctttgcccacactcaagtgaggaaggaccatgggactcttcccgtcatgcgggcgacagatgtggttcagccactgcaaaataaaaagccaggccctctgtataacgaaattcagtgaccactttgtttcattaagaggcagtctgttctgtggacctgggagggagagacagggagcgtttttcaccaacaacttacaactccacagtaagttgagaggagtcccgactccatgctgtatgaagtccagcactgacacaccatggccagcgaccaacttgctaagtcaaaaaaatctaactcagaaccctttgactgaggaacagttttcacactccagaaaattctaaatgactttcatttgctgttggttcacatgccctcgtggaagactttgcttgctgctttgttttcataagcagcttgaaggaaactcaggcaggaactatggaactccagctgctgctgtaactgcatcttgacgatgcaaaatgacgatggaaatatagaagcatgtacatcatatctatcatgaattgagcatgtgggtctgttccctcgaatgaaaaatacatgcaaataaaaatatttggctataggtggtgcaacttttaacagttgttctagaacttacacatccaaatatgtgttttcactttgcacagggtggcctatggagttttatgcttgctctagtaatgttgtagtggaaaacattttggaagtattttaatgtattaaccacattgtttaatatctttaacctcattaaatcacagtcctttaaggaatgatatgtgtgcactcttgtatgtgtatgagtgtatgtatgtgtgtgtgcagttgcatgtgtgggagtggggatgcacgtgtgtgtttggtgtgtgtatatgagcatgtgtgagtatgtgtgtatatgtgtgtgcaattgcatgtgtatgtatgtgtatgtatgtgtgtttgttgtgtggtatgtatatgggcatgtgtgtgtatatatgtgtgtgtgcagttgatgtgtttgggggatacctgtgcttgttgtgtggtatgtgtatgtatgggcatgtgtgtgtatatatgtgtgtgtgcagctgatgtgtgtgtggggatgcatgtgtgtgcattgtgtatatgtgtctgggcatgtgtgtgtatctatgtgtgtgtgcagtttggggatgcatgtgtggtgtgcatatgtatatggacatgtgtgagtatgtgagtatatggtgtatgcataattgtgtgcatatatgtgtgtgtggcatgcatgtgaggcacgtgggggtttgtgtgtgtatgaagaacaaatcatttggaaacaagtatggtgaatccatctaggtagtttggtgtagggttaaaaaatgattataaattttgtgattgattttcttattggtccaaagactgattctggccagtatattctaggactacccttggtggtggtatcatggggataaaaatgtggctttctgagacaacgccttggaagcgtgtcacttgctggaacataggcatctcagtacagcaatatgtagagtagcacgccatgcctgtgggcctttcaaaagtcctcatgtgaacgtgagcctttcttcctgtggtactgatgatcattacgttcacgttgcaaagtctcattagtttgatttttgaacccagttgttggaaaagggtgttgatgtgtcccccagaaatggggaaggtgctgaatggaaacctaacttaatcgtactgtggattgaatgcgttgcctttttaaagaatgtcttggcagttcccgtgattttgtctaactctctggctattttttcctctctggatttagctctaaatcaaaaacccacacacaattactgcacaggggatgacccttctcagaaaaattccaaaacctctggagtagattgggtttttttacccattgagataaagaaggatattacaccatagttttgaattacaatgctgatatcctattcagggcttattaggatataacttgaagtaaatgttgagagtaatcagcaggacattttgaaagaaaagttacagttaacctagatgacagttaaacaattgtttatccccgataactgcattcagatgggccaatagcagaagtcactctgaaattcatgaaagtgtaactaacaggactgtcactactgcaagcagcatatttaatgtttttactgtttttttataaaaaaaggtttctattacagtgttcttgagtattggactaaaatgcaaacgtcacttgtaaatctattcctttgggcttcatgaagatttgaggtaggtgctcaggaagtgaatctccccaagaaactcctctcttagaatacactctgaccccaagcctgttggtagcaagactgcaggagcacatggctttgcaggcagcagaccttggctcatacccaaactccccactcactgaacctgcagcctcccccttccatcttcgacttctttatttggggaacagccacaataatgctggtggctgtagggactggggacaacatatccagcgcagagcttggttttattagagctatttaataaatgatggtcacaaatatgactattaataattagctattaattcaatttacacttggatttaattaataatagtaataagtgggtttattgtcactctaataagaacatatttgcaggctaaaacatcactcccaggaaaatcaccgtgttgacatatttatcttttcttaacattttcttctaccaataacgcagtgtaagaatcaaccttaatagatcactcactttgtgccaagctctgttctaagcactctgaaaatattaacatatgcaattatcgtagccatcccacgaggtaaccattgttatcccatttttccacgtgaggacactgtggtaggttaagacacttgatgaaagctggtaagtggtagagatatataactgttaagtaacaagaacacaattttatttcttattttatttatttatttatttatttatttatttatttatttattttttggagacagagtcttgctctgtcacccaggctggcacacagtggcacaatcttggctcactgcaacctccgcctcccaggttcaagcaattctcctgcctcagcttcccaaggagctgggattacaggcgtgcaccaccacggccagctaattttagtatttttagtagagacggggtttcactatgttggccaggcggctcttaaactcctgacctcaagtgatccgcccgcttcgacctcccctaatgccaggattacaggcataagccgctgcgcccagcctaagaacacaattttaaatgccaggattcatacctctaaataaaatgggtgcatcctctacaaggcccaggatgtggtgggctctccctgggctgtgactgtgtcttccttgaattgtcttcagaatcattgataagtcccacgcctctgtttcctatctccattgtcacagctgatttatgaacacaaacagtattgcaaaacttaacaccaccactgtttgttgtaaatttacataccttgtgactcatttttaaaaaatcaaatatagcaacaaagtacaaagatttaccaccactgactatgtaagagaaggcactaggagatcttaggatattatgctaagtggtatttcaaaggcattttgtatcttagtataagatctctggtgtgcaattttgtgtgatttgaatagggcctactttgcaaggggccacgcagacggatttcagcatcagaattgatttataccagtagcctcttctttatggtcataccacatatttagaatttgaactttctctgatgcagtagactgcatcttgctacctgagaaagatacaaaccaccctcatcttggcctgaaaagagcctctcccagatgctcagcatccagtacagggaagaagatgatatggtatggggggtttggagccaaaaattgatttgagacatgggtctttgtgactctagcttagtgacttaacctttcaacacctctgtttcctcccctgtccaatggggagattgacctcacctgagagagtgtcctgagaaccaagtgtaatgatgtgtgttgaggggtggggacagggctggcacagtgcctggcatgttctaaccatctataattttattcttttttcccctccctattccattctctctgtggccccatagagaagactccaatctgtggttttcattgatggtggcagctttagccaggcagtggtttccctgttgtacaattcaatagcctgcatgcagggacatgcttctcaggtggcctctggatacacgtgtcctttgtggcctacagaagactttcttacacagtgcactgttaactgagcagaggcagccgtacctggggtgctgattagcactgtgcaatgtactgattggtactgtgtaatttttaggacctccttttgttccctacgccccttgggagagtgtggcacactggaagaaagacacgctgtatcctgggcacaggtcttctgttagactcaatggtgggaaggggatgggatgcagcccagggcctccctgcccatggcattttctcaggagctgtctcctttgagttgctatcaaatcgcatatgttgcatgcttacttgaaaggaatttgcacagagtggtttgtttatactagttaggcatcaaaaagaccattgttctcccagactttcagtataacaaacaaatttaaaaaaagtatgtatatttgggtagataaatatagggttgattcctaaagggtttagaaataaccacaaataggcccatttataacaagaggttgaaggagagattgccactctttggagccacatctgaatgccagaagttcccttgacatcctgctcagtccaagggtcacaacatgtctgatgcctagctctggactcaagggcatcagacatcagaacacgtctctctctggactcagggacaatacccatacatatctgtggaatcaggataccttacctcctatctccagttcctaccccactgtgaagctcagagtgatattgagtgagccctttctgaatcgggaccagtctcatctcagcttattacccgtgggccccagtaatgcaatctgttcaccttctgaacactgggatccccgttgtcttgtcctaggtcactcatttgagagacagaagcgagtagaggctgtaagcatgaactctgcagccacagggttgctttgaatcctggacttgacacagctgtgtaaacttgagcaagttattgcaactctgtgtgcctcagtttacctatctgtaaagtgaggatacaaatgatctacttcatagggctattttaaaaatagttaatatgtaagtaactattagaatgcctagaacacggtacttgttagtaagagttattcattgtcatcatcatagtcattatcatcatcatcatcaagaatttgatgagtacctgtaaaggctaagcaatatccgaggctcatggggtacacagcaataaactaggcagggctctgttctttgagaaacttactctttatttgagacaaacaataaagagagctcttttagcacaaggcactgtaggaattccagtaacaaggagtcgtcctatgtagacagaacttgtgcatcgttgatgatctcgacgatcttgctaaattgaagcttggatgggcaagtaagactcagactttactccaagcaattccaagcatatgaaagcacgatgggcagatattagcctgccatccatacacagtattggatatcgcactctctgtgggacatttgctccttattctgacatcataagaacagaaaaccagtgcttctggacacgaatcatttcagggctctttgcagatgcatagcatgaaagcagctgtttcagaattcaaaaattatacatcatgccgtatatggcttttcgctttacaagttgctttcaaacattgcctcatgttggcctcatgacatccatgttagataagcgtggtgagaattacttccctgtttgataaacggggaagctgagtcagggggagctgcctcatcatggtcactaaagagaggcgagtgagacctggaaccccactgggtcttctgtcttctgggtgagctcttggttgaggggactgtgagatgcctgtgtaggtgagtctttgctgatttatagactcaatggactaattgttgctggatgctaccagaactatgaaacaatctgcaggacgaaaaagcagatgagtcatgcaaattttaacaaattagttatgtttctgaaattaaaagtaggtaaagaacacaaaagaattggaaacaaggactcagatacttatatgcctatgttctttgcagcattaacaataaccaaaagggggaaacaacccaagtgtctatcaactgatggatggatcaataaaatgtggtatatccgtacaatggaatattattcagccttaaaaagaaatgaagttctgatacatgttacaacatggatcaatcttgaaaacactatgccagagactgggcgcgttggcttacgcccgtaatcccagcactttgggaggccgagacaggctgatcacttgaggtcaggagttcaagaccagcctgaccaagatggtgaaaccctgtctctactaaaaatacaaaaattagccgggcgtggtggtgtgcacctgtaaccccagctacttgggaggccaaggcaggagaattgcttgaacacaggaggtggaggttgcagtgagcaaagactgggccactgcactccagcctgggtgacagagcgagacttcatctcaaaacaaaacaaaacaaaacaaaaacattatgccaaatgacataaactgaacaaaaaggacaaatactgtatgaatccatttatgtgaaacatctaggttagctaacctcatagagacagaaaatagattagaggttaccagaggccagagggaggagaaatagacatgtattgcttaatgactacaaaattgctgtttggtgtgaggaaaagttttgaatatagatgttggcaatggttgcacaatattgtgaatgcatttattgccactgaattaaacactgaattaaaactgcttttatattttaattatacactgaaataaaactgcttttaactagtttattttaattatacactgaattaaaactgctttttactagttttatcatatatcatactagtttgttgttgttgttgttgttttgagatggagttttgctcttgtcacccaggctggagtgcagtggcgcagtcttggctcattgcaacctccacctcccaggttcaagcgattctcctgcctcagcctcccaagtagcttggataacaggcacccgccaccacacttggctaatgtttgcattattagtagagacggggtttcaccgtgttggccaggctggtctcaaactcctgacttcaggtgatctgcccaccttggcctcacaaaaagctaggattacgggcatgagccactgctcccaccctcctactagttttattatatcattttaggttattataaaatcacagccatagtaacttcctgtgaggaaacggtttaaaaatatgagagcaggccacatggccacctaaggaaatttatacattttgagaagcgtgaaagcttattctatttccctgagaaaaggtattgatatcacaatgcagaggtgatcttattttaatttcagcactattactgctgtgcatttattacaatcaggcagagtactgatgtgtttcgaatacgggaaagacagaatctgaaaagagatagcaatttaactttctgcaggaaaactccggcgtgtttttcattctgacaacttgactggtgataagaaagatgaggtactacttttgtaaacttgttatccttacactctcaagaaccatttgtcatccatttttccctgtcatactgaaatatacctctaagaaaatatcggtaatttctcagtattttaaaaacatagattctcttgatcagtctactaaatatttcatagtttgtgtgttgttcattagaaaagaagagattccattttcccaaactgtggaactgagcagcgcactgagattttaaggagtgggatgtgggtaccctgagaagggacatggttttgtccagagctgaggaaaagaaaaattgaccccgagatcccagcttagccaacagccctgggcaatttcatcagcttcctatatctcggtgtagccacgagcaagatcattttgtggcactgaactcacggtctgcaactcatgtgcattcaggacagacattgaggcttagggtcaggctgtaggtggcaccagccatcatgggacattcagaccagagaatgcagcaaccaagagcttgcttaggtaggcaagcaggagcgtttgtccactccatagccagccttcatctatcaggggacttgaaatgttcattgcacattcccctgtaggcaagagtatttattgagaagacctgaattttaatgcaaagctttccaaatggttgtttgtagccagttgacctttgagtccagacatcaggtggctccattcctctccagggccatggagcttcactgtgaccttgggggactgtccagccctctccatagtgttgagggagcagctccagctcttctcccctcactcttcctggcctccctggggccagtatcccattgttaacaccagcaccagtcccatgcctatgatttcttcttttttttttttttttcttttgagacagtctcactctgtcacccaggctgaagtgcagtggagctatcttggctcattgcgacctccacctcctgggttcaaggaattctgcctcagcctcccgagtagctggaatcacaagcatgcactaccatgcccggctaatttttgtatgtttagtagagacaggggttcaccatgttggccagactggtcctaaactcctgacctcaagtgacccacccacctcggccttaaactgctgggattacaggtgtgagccaccgtgcctggcctatgcctgtgattgctttacttcagaaaagaaagcatgcagtgtctgacttctgagcaaagctgtggctcccaacaggaagacatcttacaaacgcaggagagatgcaagctcacttagaaggggaaacgtgcttagttaatgccagggttcacatgtgaccatgtttaaaatgaccacagagggaaggagaacaaaaaagcaaactttgctgacactcaaatgttttctgtttctaagtggatgaccctgcctttctagatacaacgggtttcattcttcatgctgggcaggttgccggggtttggacaaatcctgctcagtgcaaagcatctcccaaggtaacagtccctgctggctgctttaggtaaatgtcagcttgttatgctgctggacagatcccacgtgggccctgttctctgtcattgccatctattctccaagaattctgtctcaatgagaagaaaaacagatcaacaggggagctgaggaatagatgggagctgcgagctgcagagggccaggactcggtgtgttccccacagcggccatctgcttggcttgtggagacgaccagctcggccacacttctgagattaggactccctgatgggccagcagaaggggctcttgtcaaatcccactttccctgattaaaccggaacaggaatgtctggcagagtagaaaatccagggaggagaggtgaggcctgcatcctggagggaaggttgtcctgagatgttcctgccatttttgtccccaaaagcgggatgatactagaggcgatggggcaggatccatcctgaatgtgtccggagagttttggaagatttgaccatcactgcaatagtctttcttctacagaaaataagtccggtaaaaatggggcaaaagttactcccacccagaggaatgagacatatgtgtccccctaccgaggggtgccccagagagtgggcacctagaagatctggttgttccccgcagtcacatacctccctgaattgaagtccttagagccacagaaaacttcctctggttttcttactagttactgttggagagagggtcattcctgattcctcctccagtgcagcctggcaggggagcctgctgagctctgctgtgtgaactttctgcccagagacaaggacagggatgagaggaggcagcaggtgagcagaagacaagacactggaagataagacctgtgcatcaggaccgagggaatatatgtgggagagacagagtccactgagatgcctcagctacccagggttcccactgtaaggaagccaccagtgtccagaggactccaggaaaaactcggatcccactttctgctactgaccagctgtgtgacctcagaccaggagtgcaatctctctgcacatctgacatctgtgtcaattcttccttaggagaggagagacgatttatgccttacccacttcttaaggcagtgttgaacaatgtcatcatgtgtaaaagcattttttaaaataagctgttgtctgcatggaggccatgattcatataaagcaatttgatttatacaatgaatctctccaagttttgctccttgcaaggttctgtgtcaataaatgttcaaacccatatttattgagcacctactataaataatcaggcgctgttttaagcacttctgatatgctggtaaaaaaaaacagatgcaaatacctgcctttgttacgctgacattctagaggacatttaaagagatctagttccatgtggatagagcaaaatgaaagggaaagttatactttagcacaaatgtcaatttcagaatggtttatttttaaaatgccagactctgccatcctgagattgactaactattgtctcaccatctctttgtcctggttaagttcagagaatacaatgtgcccagagtgcagccctgtttgaaaaggacggcttgcagagttgcagcaaaagtcatttctgggcagacgataatactaaacggaagctgatgaaagaaagagaaaaaaataccatgagagaagggggatgctggtgaaggtaaaatgttagtggagaggtagatttcaaatagaatcgcctaggttgaaaataaaaagcagtcatcaactatgatggaaaaatatttccgagacttgataagtcatccggaccctggctgctcactcccagggttgcgtgggatcctttgcaggatgagcagaggctgtcagtgtgggatgcgtaacacagcaggcacagggtaactgatctaattatgaagagcccttcccatctgatcctgactttgacctatggcttgtgaggccccagcaacattgaatccagggtgaaagtcagaaggactaggacccactcagctagttcaatcctctcatgccttcagtggctggagatatttagggagcacatcctatatgctaagccctaaataaggtgtcaggaatatagcagtgaactaggatggcaggtcccttccccaatgaaacccagtgtgggacaaaatgtgatcctggaaggtgagggtgattctgcaactcataaataaactgcgtgtgccagtagcaggccttgtggtaacacctaggcaggaccaccttctctgcacaacttcagagagcataacttaatttttacacattgaattttgatgtatttatttgtcattgcctaacatcccaaccccagcgtctgatggggatggcagtcctggcgttatgccatgggtagggtactgaggctagattccctgaatcctgaccgagtctcatcccatgagccagggtgatgaggctaatcaaacaaggaaccaaggagcccataggttgaaatacaaggtttggaagaaaatgtgatgcttgctggaatgaccagatgggcgaggatgttgaaaaataaatgaggtgtgatcattgcaattcattcccatcattacgaaatcatttattattaagttacacatggacacactgcagtgccaaggaaaagtacaaatgaaaggtaaaaacaagggacaaatgttgctcatgttgccagtaccttgttttgagtctggaagagaattatttatgttgctgcagccaaacgtctctaaagaaaatgatcaaattgtaattggtcaacatgttctctcaatgataccttgatacatcattttaattttaagtttttattcatctctaatgttttacttcaggcacttcttatttctttcttggaccattccaaaaatgtcctaaactggtatctcggccccagtccatcttctacgctctgaaaaaatacctttggttttatttttgcagagtcgattttttcccttcgtggatgggctccttggcaatctgagccttcgccctgctccctgccacccccctgccttgcactccaggcatgcacattcatgaaaattcctcaaaatcttagggaggctgaggcaggagaatcccttggacccgggaggtggaggttgcagtgagccgagattgcaccattgaacgcactgtagcctgtgtgacaagagcaaaactctgtctccaaaaaaaaaaaaaaaattccctcttgctcatgactcatttgtatgtgatgttccacttggcagccattttcctctagtccactggcccctggtgttcccgcggggcttcttacatgagccattctagaatcgcaggtcccttgctcttcctctgcacatgcctgtgtttatctggagagagtctgtttgtttccctgtttgccttcttaccagacttggagcccttcaaagccaagggctgtcccatatggatagaccttccccagtgtctaaataggaactgggatatgatagatgttcaataaaaattaaacaagagacaaaacaaaagtagggaccaatctggaatccagtaaccatctctcatttcaggagaagtggaaactctcaggaagttgaaaatactgggcttcagaacctgacctagtttgcagccaccgctcccctccaaaaacaatcccataagaattccttctgacccctgagatgagagggtcactgaggtggatcctggccttggaaatccctgttaggacctattgggaccttttacttgcccatcaccaccaccctaacattacattagaaaccaacttgggcttgaaatggaggcctctgagtttgcatgaaccccaaaatgcaggctcagattggtttcattgcaaaaagggaagttgcattccagttatctctgaataaaacttgtgatggtaaggacacagcccctacccctagaagtgaaaactggcaagtctccaggaaccaagaccactccaaggtccagttcttgcatcagcgaggccttgcttccttcttgcttcttaacaactggattccatgctcactcacggcttctcctctctctacctctggaatgtgcattgctgtcagagctgctttgtaatggctgcgtcctcatagcctagactctctctcctgagctttgaagcttcagtctgccctgctagccactaacagactcctgaatttctaagttcaggttcctacaatggaaaataagattgacctgactcatttcttcatgtggaatttttggctacagattggctgttgtttggtcaggccacaaaccccggtccaattgaccatgttttaccatattctcatcttgtccttagaaggttgcacagaggtgagttactgaccagaatgaacctaggcatggacatttaggaatttcctattaaacataaacacttcagagaagaaaagcatattccatcttaatacctcagaataaaggagcgtatcagcttcattccttttcagaggtacagcaggaatctatacacatcagggggccagttaatctgaaggatgagggggacgtctgaaagcagatgaggagaggaaaggaagaaggtagccctgaacctctgaactatgttcctggatctcgtcaatttagtccttactctctgtcaagttgatccattgacagattctcaaaaccaggtcaatatagagatatggcactcttacgtcttgtgtcagctgtatctgttatcaatagttttatgaatggcaccaccgacaaaggataaaaacctaactgcgattaggcaaggaaaatatatatataccagattttctggtcccccacaagtttcaccctagtgactgttctctgtcatcccacgcagggtgggctttgagaactcatcaatcctcttgtgagtttcagtcttgcatcttttctgggatctggctcaaacgtggctaatttcccagcatactatgttcagtacaagggcaatctgtcagcattcgtctgagcatgtttgtaaagacacataattcactatgaaaccaattcatttcagatgtgctttttcccattgcaccaaagccccgggttgatttggcagtttggtatattatacaaataaatatgtcgaaaatgggaagttaacaactgttggaacctgaggtttctgaaggacttggctctggtgtcaacttcagaaggtcatctggagaagctaagggatctgaacattcttaaaaggaagagaaatgctttagaataaaaggaatcctgtgtccacaggcaggcagagtctcgtttttgatttcctagggaacttagcacagtggagttccaatagctcataggaaatcgcgtttcacaaaagttacacaaaacaatacctttctgaggagtttatgttctaataggaaatacctaaaatatatttatccactttttaaattttattctaccttctctcttttaacactgatttacataataagggacagattaaattaatttcataatagaaatcttgggctttaaaaattatcttagaaaggtaattgtcttcatttggtgttttatgttccctaagtagttatctttgctgtttcttgtgggggttgctggcaattctgacttcccattccatatctcatttattacttcatttaggaaatactctttttttaatttgataggctgaggtctatttcctaatgactttcacctagttttaattttcagcaaaagaaacacttaagatataagtcataggtaatacttaggcctgtctgatgaatgacggaatctagcttccgctggtatttcatctttgacttctaacatgtaagaagccttcactttagtggtcatctctcctcctttttcgtccttgctcctttcagaagtgttcatctgtagcgtaggattcagtgatccccaagtgttttaagctgcagagctctttgttccgatgcttgtaattcacataaaggagataaaagtggagctgtgtgggctgaaggatgagaaggggagaggggggaaatggagccccaagttctagacaagcctccccccatcaactccttcatcctggcagcctaggaaaggttactctagcacaatttggaaacatctggctgagtcattttggcccacattttctttctgctgaattcatttgcattctcccagggcgacatacataaatgttttctagttcatgttgacatctttcagttattcatgaactgtgaccctactaccctgtgaggttctatgagaagctctgtgtgttgcaattctgtctgcattgctttgcagatgatgagttgcctaaaatgaatgaactggttctgacctatctaagtgtatcacatggagatgctcttgtctcttgatttcagtctaggtgacactcaggttttccaaaagttctctccctgatacacacattatttcattgtttcctgtgtgctaagcgcacacaggatgcaaagatgaataagaccttcccttacggagccctcagcctagccatgacgagagccagttatggagtccctactagatgtccattgctttacatagtttctatctcattaactttggtgcacatagccagtaagcgaaaggacccgggatttgcaaacaagaaattattctgacttcaacgctcattcctttcactgatgggcaaccctttatcttacctggtccctgccacggagaaactcacaggcagggccgggcagagaagtggtcagtgatgctctaaggtaacaagcacttcccataagcctggggtaggaggtgacatttgcacggggcactaaaggatgattaggagctcatcaggtggaaggagttgggagtggggctggagctggtgtctttgctaatgccttctaggggaagatgccaagtgttttagatttccattgcttatacttatctccagtttttagtggcctacttgaatgtcatttatattgtcatttacaccactccccaaggccaaatcatatctgtgttgcaaagttggccaacagggattgtatgaactgagccttctctggagattttctgcatgggtctgttagttcatgtatttcatgttgagaataaagtatgggcacgtgaaggtttgggggatattttacataagacattctcctatgtaggcatgaaaatctttcctgactccaatcctgttgctaaacagcgaggtctagcccagaaggcatggaggggagcagagtttctgggaaacaagaagaggacttggagccccagacaggggacaactccagagggtttcttggggatacctttccctacaggccactgaagacagcacggcagtggaaacatctgcatcacccaccctggtgtgtgttcccccgacaatctgtgggcttgttccacagctggcaccaaattctggctgagcagacagccccagaaatgtcacctggagccgttaaaaaaacataaacaaggcatctgtcacgctgccgtcgccaaggtcatctggtggcaggaggtgaccgaggaggagcatggtggtgccgtgccatcgagggccaacctgtgggcagacctgcctgtgccggcgctcccttgctctgcagatgcattcaaggatgtgaagttgtgcaggggccagacgtgagaagcaaaacaacctgaatgaaatccagccactttggagtgaaacatgagcattttaaaacatgattttcaaactgtcgcagggttagtattgcatctggtctcctctcatgattgcctggaggccaccagcccaaagctggagtgagacatgagctggagggtaacctgaacaccgaatttagggagtgtgttgttcatacaaatcactcagactgagagttagagatgggatttacacccaagctatccatcaaaccactatctgtgtgaccttcgacaacttatccatttcctctaagccccaattttcatatctgtaaattccctcctaggatccttgtgaaggttagataagatagtatgtgtaataatgcagggctgcagagggccctcagtacattttattttggctttctctgccctcacttacaggtgagggaacagatttagagacggggagttcatagcataccagcatcaatgatcctagcaagaactgtcgtactttcttcctccttccttcacttcctttttccttatttccctcataatccactccccttcccctccctaccctcagtgcacatgatattatgtttgatgggtagcttttggtttgtatataattttggcaaaacacattctttgtagaaatgtattctttaatttgttaaatggtttgagtttatacatggatgccttatgtgttttgtgcgtatttacatttatatttagattcctcttttttcttaagtactgtgtctatgttccctccctgttgctctgtgtacacataatcgattgcttattgctctgtgtatgcataaacagttgcttcttttttttttttttttttgagacagagtctctctctgtcacccaggctggagtgcagtggtgctatctcggctcactgcaagctctacctcccaggttcacgccattctcctgcctcagcctcccgagcagctgagactacaggcacctgccaccatgctggctaattttttgtattttttagtaaagacggggtttcaccatgttagccaggatggtctcaatctcgtgaccttgtgatccgcctgcctcggcctcgcaaagtgctgggatgacaggcgtgagccaccgcgcccggctgccgttgcttctaattgctgcttagccttgcatggttgcatccagtctgttccacaaggatggacacccaggttgcctccacactatccccatagtccatcttcttgtaattcttaagataggaccaaaagacatttatttacaagtttccctcttctattagacggtgagacagtgagagaagatttcctgactttatatacaaagcagctagcacatagcagtttctcagtaaacacaaagccattggcttcccaggcagctggacacatgggctcaggcccagcctcctgtgtccttggttcccaggaaaagtgacagccttaacggcagcactgtgattaccgttatcttgtcatgaaggtttatgacgagtaagggaagtgccttttaggaagagaaaagatgaaaagccttcccatgtgacgtatactagaattccctgaaacctgaaggccccacatgatgcacctgtttattcaaacacatacatttgagtactaactgtaagtgatagtgggtatggatttggtgaactctttgaatgctttcagcatttccccaatctgtaggagattctagttccttagaattggatactgagccctgtttgatgaaacttgctgtggcatttggagaggatgcagctagggttcacacatttaaccatggatggatctgtcagtcagtctcagttcatggtagacaagaaaggagatacatgctgacaagccgtgtaggaagtgtactgccttaagcagtgtaaacatctttattcctgaaaggcatatctgctaggttgattgtgaaatgtattctgtttttttttttttgttttgtttttctatttggagggtgagggatagcctactttaatatcagaagattttttttttattgaattgtggtactgagtgaaatgacctacctttacttgacctgcaacagagttgctgtagaccaggggtgggcaaattctttctgcaagaaccaggtaataagtattttacactttacggctacatggcctttgtcaaacctgtcacctctcctgttgtggtacataggcagccattagacagtctataagtaaatgggcttagctgcattccaataaaactttattcacaaaataagaagggggccaggtttggcccatgagccctggttttcctacccttgtttagatgctcatgcacttgctacacctggaaatcaacataaatatagtaggtccaataaggcaaaccagctactgtttcttgccagtattctctgctctctcttcaggacactctgaacacaatggataggagtaatatgaacagaaaacagaagaaggacttggactgtatcaattttggcttggttgtgcacgccagaaaacctaaaataacagtgcccagtacacagcagaagtttatttctctttcttgtaaatacagtttggagacaagcagtccagggatagcatggctcctcttctcacaaaagcctctgctccttctattatgttttctcccacgaagggtttggtctcatggttccagattgtagcaagcattccagataggcagatgggaaaaggcgggaaggagagggagagtaaatgaagagcgtgcacgctgacagatgctgcgacgagcttttccagttgctgcctgtcatggttagttttaggtgtcagcttggctaggccacggtacccagcttcttctcaaacaccaggcgacatgttgctgtggagttttgttttgaagatgtgattgataattcagttagcggacatggagtagagcaggtccccctctaccatgtgggtgggcctcgtccgattagttgaaggctttaggagaaaataatgaggtctcccagggaggaaaggattctgcctccagacagccttcaggcttgagccaccatcccaactcttccccgggtttccagccagctgccctgccctgcagacttcacatctgccagcccccacaatccaccatccttaaaaatctgtctctctctctccacacacacacatacacacactattggttgtgcatctctggagacccctgctgcgtgtgcagcctattcatctagaaggctccggggcagtgggggatctactccttatccacagcattctaatattctggagacacaagagaagggacatggaagggcaggcagacattaaactacccagaagcgatgtgtgcctgtgctcttattgcacctccacattcttatttttcttactaataaagaatttaaaatgaaggaagccccagatcacccgggtgtgattctctagccttttcccacttctagttcaagagatgtacccgtgttcttttaaccaaagaaaaaatcattgcatcctttactctagcagtagtgcctgaagcatggggtgaaggtgatgagtgcgttagggcctttgggaactctgtcccagccaaccctcaccgtccataccctgctgggagggaaagctgtggccccggcagctctcttggtttatactcccaagaggaaactcttcctctcgaagcctgggggagggacagactttggaccaagttcactctcccagctataatttgaagtgtggacaaaatgggcccagatgttcagccttgcttgttgggcctggctctggtctgcgttctcatccgcgagaccctcggcctccctgcccacaccaactcgccttgggtcttctttgagacattcttactgaacaagaaataattccccagggttagattactggacacaggagaaatgtgttctgcaagctgaggagaattgaatttggcttcagggacttcctcctccccaggtgaggtttaccagtctgtaaggatctcacaggtgatttgggtccatttttggtgcactttatttctcttcctagaccctttcctctgtcttcccagacccttcccctcaaaggggtgctggcgttgggttgcccacggctccttgccccggtgagccctgaccacgcagacccagcagcttccagggacctcagcatttaagtaatgggcgtgcaagagaaaaccaaaaccaaacccaaacaagcctccaaatgcagggagaactcctcagtgggagctggagagttctagttgaaatgtctgaggtgacagtgagcacgcagtggtcgactgtcggaaagctggtcctcaggccagaaaactcatccacagttccatcccaacttggtctttttgtatgagttgaagaaaaagtgtgggttttttgttgttgttgtttctttctttccaactagtttctttggatcctggcatgactccagaagaatcgtaccctgctgccccacattcatttttatttttaggggattgtaagttagaagaagtgacttctcttgcagatggcaaagacttacaatccaaaatcatcacaactcacaatttaaagacattttgatctctaccttcctgagcaaatcagccggcaggcctatttcttgtagggctttcgtctgcacatagtaggtcctggataaacacttgctgattaaatgatattcgaagcaaagcgactgcagctgattgtctacttagggcaaggtgagtgtaaatcagaagggtgagaaattgcatcaggctgcggagggatgcaggcttgcacggctacaaacaaacctaattagctgtgcctctgccagcagccctactcagacacatctggaggggggagaatggctaaggctagattggctttcccaagtgaaaacgcctctcttcagttgcacctgcacaggactgattgcgcctcaaatccatttgtcaggctggttgcaggtatctgagaaattgctaatagaattgggcaaaagtgcccgtgggagtgggaggtaaatagcatggcaagacaagcggctgctggagtcccgggttggcaggtgggcctgcccccatgccccgccaggctccagggggtacctatgcccagtgactacagagaagacccgtcttggctgagcatcaggctctggtgcagtctttgctaagtgtgtttatcggccaccacgagagtacttagctgcaaaatggaggtgctttcactcacagacaccaggagccttcactagggaggcactgagatcagcactttttccaagatgctccttgcaaggtacttgtgctccatcaaattgcaattcttcctagacacaaagggaggcactggcccagagtcaaggtcatagcaagaccccttgagctgcctgtttcttagcagaagctggagtagacagacatgacttgagacgtcttaaacttgtttggagaatttgggactggatctcccgcccaagcactttggaggggtctgaagagacacaggacgtgtgtatacgtgtgtggggatttggggctgtgtgtgtgtggggttggggcaagggcttggatcaaacatctggatatgaataccaactctgctgttttctgctgactgtgaacttggaagagtttcttatcagttcaagcctcacttccctcataaatgaaatggggatagtaatcattattatgggctgttgggtcccccaaaaatccatgtgttgaagtcttaacacccagtgcttcagaatgtgatgatatttggagatacggtctttaaagaggtgaatcaagttaaaatgaggtcctatgggtgggccctaatttaatatggctgatgtccttataagaagagagattaggacacagacacacacaggcgatgttatatggtggtttagggtctagactgccaaggttcaagttctgctgtgacttacttgctctgagtgaccttgggtttcatattaaattttctgaatatcaatttcctcacctgtaaaatgggggaaataacagtctgcctcatggtgttgctggaggtgtgaggtcagatattaaccatctggcacttccaccgctgcaggtagcttggccattgttattgttatgattaagggcaggtgagcatgtagtgtctttctttgctaagtatgtctgatgccaagtcagtattcattgagcacctcttctgtgcaaggcgcttggaaaggagtgcagtggctctttttccccactcttgcccctgctagattcatcctcaagtcttctctgagttgcttttcctgcagcccgtagttactgaaaaccataatacttatagatgctgctttctagaaatgagcctgtaaagtcttgtattttctcttggtctgcacaactttagggggggtaacacgtcctgtatttgccagttgttaaccttctctttgaccacggagctctagatgatggcaccgataatgcccaggcagatttagttttgatctccaatgaaagataggcctttctgtatttgcagtaataagcaaacacctttagcttgagaggataaacttaagtacaatgtttgttctctggaggcatactgattaactttaaaatatgaataaaaggcagtcctatttcattatggtaagaacacttaatacaagatctgccctctttttttttttttttttttttttttttgttggagacagagctctcacccgggctgtcacccagctctgtcacccaggctggagtgcagtggtgcaatctcggctcactgcaacctccacctcccaggttcaagtgatcctcctgcctcagcctcccgagcagctaggactacaggagcgtgacaccacgcccggctaattttttgcatttttagcagagacggggtttcaccatgttagccaggatggtctcgatctcctgacctcgtgatctaccctcttaacggatttttagtgtgcaagttatctgtaggtacaaggttgtacagcagatctgtcaaacttattcatctcacataattgagactttatgcctttcaattagcaactcctcacctcccgctcccaccagtcccaggcaaccactaccctgttccttttgcctccgtgagtttggctactttcaaagcctcatagaagtggaactgtgccgcatttgttcttctgtgcctggctcatttctcttggcatctttcctccaggttcattcatgctgtcaccaatggcaggatatctcgctcttttgtttttaaaaacagccaaagtcaagtatgtaaaaaggtgggcagctgagaacctggtaccagaatgttccaaggaaaggtactgagtggcacaacctggcctggttctccaccagtaattcctaaacttccccacctggaggctcctgatgacagatgggtgaatggcagagtagatgagtgagggaggtggggagccccggtggggcctggctggtcaaagtccaagcaatctgatcccagcaggacattcctttgaaggatcatgtatcactttacaaatatccacaagctttgcactctatccatatttgtttaggtgtaaaaaaatattttaagctctttactgagaaggaaaatgggatgcacccacatggattccccagcatgcaccgctgagcattccctgtggtaccgctcctcagtttagggtttaggtcaggggccctggaatcattgaaggagacctgtcttcctctcgtctgctgtcttcctcctggatatcacccctgggtcaagcccatggtctcagtgggttagcaatgaatccttcctaagatgcgaacagatgggagctcaacatttgacccatccctggggttttagtttttttgtttgtttgtttgttttgagacggagtcttgccctgtcacccaggctggagtgcaatggcaccatctcagctcactgcaacttccgcccctcaggttcaagcgattctcctgccttagcctctcaagtagctgggattacaggcatgcgccgccacgcccagctaattggggttttaggtttaagaggaatcccagaaggacagggtgatctgaggtcctgagcaactctgaggctgaaactgcgctggtctactttaaggcaggggctgtgattttccctgtgactgaggtcctccaggggtcaactgcatttcaggtgtgtgaggggagagtgactgcccacctggctacccagcccttctttctgagcctgtttactcagctgctggggcctccatgacaggtttgcttggtgaccttacaccgcagtggctcccagggccagagacgtgaccaaggagggaccttgcactgaggaacctgtgaccgtaggaagaccctctaaggccgactcttgcttggcccggcccagtccctcctaccaacactgataagaacttaggttcctagcatcccaggaggcagggtcacaaagacaagctgagaactgataccactgctatacccacccctggacctccctgtcccatgcaggagtctaagccagtgcaaccaaggccaagcacacacccataccacacagcaagggtttcacacggggttttcatttctttacccctggccgaaccatgcaagctaccagccatctacccagacttcttagagtctgccaaatacgtactcagaccagaattaagttcaggccatggtagaggtgaccagccactctgccgtgacctggattcagccatcaattccaaagaagcccacagtgccttgcattttgctggctggtttgtttttgtaaaatgatggggtgggaagcagtgctgggcattggaaaggggctgaacaaggggaaatcttcaacaccttttaaatggaagcatgtctagttggcctcttttctgtaaggaactatactgggcatcacagagatgcaaagactagagtgactgattcaggccctggcctgaaggactttattattgagagttccccgtatatataaatggctgaactctcaggccagtgaatgcctgtgaccaagtgccaatgggtgaaagtagaggttccagaccaggagtgggaaatgcatcaacagagagcttggccacatgctggcctggagtgcagagaaagagtgccaggcctctgggcactgagttctgagctgcttctggagggccaggagatactcccacctgcaaatgactggctgattgcactttccttagagtttgccacctgcatttccgctctacccactaactgactgctccggtgcagggagccaggcaggggcagtggtacctgggtcaggacacgacagcagcctctggcctcaggcagggagtgctggacagtccgtctcctgtcctgctttgtctctttctccttgagctcaggacacagtggggagccctcatgtttctgtaaggtcatcacacaggctggaatgttttttttttcctctctctctctccctgtctttcttttaatggacaaacacccttgaggtcctggttgattttcttagagaaatgtagattctttgattctaacgatggaacataagttttctgaattttgaggaaaacaaagcccaagatttcaacaaccagtgttcctgccaaatccactgggcaaacagaaaagctgcctgcctccggtgctcccagacccccttccttctcaaacacgcatcagacactttgcaccaagaaaaaacaaagggcatccctcctggggccacctctgccccctgtccaggtacgcgctgtctggcgcgccctgcgtgggggccgcaggttcagacacccgggcgcggcgcggggccctgatggatgcggtgaccgaggctgtggctgcgggcgcggcgtctccgcggcagtcgctgcctccgcggccccctccccagccccagccccagccccagccccagccccagccccagccccagccccagccccagccccagcccggctgagcgggcggccggagcatgcgccgtgggcgccgggccgggaggcgggcgaggaggcagcgcgcatcactcgggtccccttcctgcacccagccgccacttgccggttgctaagcagttatcattgtttctgtggcgattgcagaggctgttgctaattggagaagccccactaagcagcggcagcttcctgcttcggatcctctctctgctgcttgcatttaaagagcaaactcgtcttgtctacccaccctccctcccccatcctccccaaaatagccttgtgatttcggaagtatggactaaaatcacactcctccttaccttaccgcttggactctggtggctcccaactcgccgtcagaccccacctgccccggtggtgggaagcgcctggacagaccatgaccacagccaaggagccaagcgcttcggggaaatccgtgcagcagcaggaacaggtaatgctgcttttgggggtccgtgtgtgtgtgtgtgcgtgcgtgtgcatgcgtgcatatgtgtgtgcatgagagagacagagacagagagggaggatatgtatttggggaagaattttgtattttgtattggtttatgactgtagccccctgagccaccaagctgggaggagacgtagagtgctgggtgctgctggagtctgcggctctcctctccctggcttctctctctaaagggcgccctggcttgatgattaaggtacaggcacagggaacctctgtcaaggtaaacttgatgtgaaacacctctggacaaaggcctctctctacagagccgccagatctaacgagttccctgggaaggttcccagctagtactttgtaacttgggggaagagggttgtagccagaaacatcagcgtattctgaccctccaacaggactttgctttggttctaagacaagtcaaagaaaatgagcttactgaaaggacttttctttggatacctcgtggccctttcctcctgtttccctcaagagcaaactgtccctgctagagaagccgaaggatagacggtcgggataaaggaggactcggccgagaaggtgcaggtttaaagggctgaccgcggacggggaaggctgcgtgggtcccacatggcacagggcggccgctcgccttgtcctgagaagaccacggtctgcagaggcccaaggggtgagggaggaaaggtgagtcagccagccgcttcaccacgcgtgtagacatcgtaattccctccttggaagatcttgagggttcttgtcttttaatcattgctcagttcacctcaggcagatcattaaaatagatcctgggagacaccaatagattcacaaagcagtttgctcaagcgtggtaaatcaacagcttaagctgacttctcctatttattttagggttgctgttggatctcatttgctaggattagggcaaagataggcgacctctttagagttcaggaagctgaagagcctccttgaggacactgtgtgacagaattccatgccaactcttcagagacttacacgaagatgagtttggatttgtatttagtggggtcatttcccaaagcccatttatcgataaaagggggccattttattagtaccatcattatcatcatctaaagaacttaaatgaagttttatgtcatctgggaagaagattctgtaaatacggacattaaaaatttttatattcagtgtgacagtgtgcataaggattgatgctcagtatagcttgacaggttcaaaacagacaaaccaaaccctcctcctttcaaaaattccacagaatatttgctcaataaagaaatatttccacactaaattagcattctgtaattaactgggtttctttttattacagttctcctccctcattagttatgaagtaagtgtgcgatgggctttcaggcttgaactaggactcaggtagcatccctgaccatgggagagaagtaataattacgaaagagtgcattgctgttcataggtctacacccgatacacccaaggattgggagtcagaagcccaatctgtgttatgtaaaagaaatcccttgtttcctgtacaaatttgctcttattttgcctgatacctgagcatgccaggagagtgggaatagttaattagggtgtgggttttggaggacctatgagctcttggtttgattttatacctttttgtcattggaaatcccatgtccttgaacctattcaatcggagaaggcttaaactgatataaaactgaagagcagaggcagccatggctacagcgagcaggtgggacacccagaagaagcagctgtcctcatcccatgcagttgtgaagccgctttttctccctcctcagagaggtgtcacctcaaccctaaaaaatgaacagcccccacccccaccatgaagtataatgaagaggggaacagcagagataagataagccagatgggacagggggtgaagaccccacatttcaagtgtatataccttgaggagaccttacctggggtctgaacacactgcttagaacataaagaggtaaataacctcctaaaataaaatccctaaagacagtctcttattcctgcattatatataattttgaaaggtattaaaactatgctgtgtgcttagactgcagaactcttaatgagttctccattctttattttattttattttcctggttgctaatgaaacttcagggatacctctattcccaggctggtaggcatgtgtagggagaccaggaaagaggaatatgtttctttttttttttttttaatttattttttgagtgagagagaggattgctgctttgtggattggttttgaagcagggggtcattaaactgtgctaactcaatgactgcctgcaaatcaccaagtgttgattcttatgagaaactcactggcacctcacatcctcatcttgtgaggcattaaccagagaactgggattgaatggagcctgatgccatctccgacatccttccagctgtttggttactgcaatagactacccattacttcttagcaagtgaacagaggaaagtgagtttctttaccagccttggtatttggaaaccaggcatatgggtggtgggtggaaataatttttgtgtgctgaggatggccacaaattaggggggaaattagaaaaaaaaaagattttactattagttagagattgttgttttttttctaccgtgtttgctaaaaaaaatgtgtaaaaagagtattttgggatttttggtttgttttttaaaggatactaaataaacaagccagagtaacaaggagaattggcttctgggagactatttctctttctctttggagatgctaaagtttatttttaaatgaagtattgcaaacccagagatgtttggaagcaatatatactttaatctgcatgaactgagttgatcctttggctctgaagccaatcaggtgatactgagactcctcggtgaaaatggctgagcattggctgcacctgacctctgctcctgcgcagagggaagcctggtgagggacccagaaaaaacactgaggcaagtctggcttaaatttactatattctcacaagccaacggagctcttccttagaaaaccaaattaagggattttttttcccttaaaataaataaaagtacaaatttattgtagtacatactgtctccatttcaaatgatttaaaattgaaaagcagtgatcagtaaagctattaagagaagacgaaaaattaattccctctgcttgcaatgagccaggacacatttttgctcaaatattaagcagggataagtttttcctagcatattgtgtgcatgtgtatgtatgtgtgtgcatgcgtatgcacacacaaacaaatgcacacacgtgaacagtcacacacaggcacacctcgtgtgtcacaaaatcagagttggaaaggaccccacacatgcactcgttggtcctagttcatgctctcgtgctgaggaatctcacaaatgtgtgagaatatgcctttcctcaaaagatctccagaaaaacctcctttcacatggaaatagcctacattccactggctaacttggatctttggttatatgttcagtcacatttttaacttccttagacctgaaaatcagctgttctcatcacaccttgtatatgtgactgctgttttttgttgcttctcagttttcttcaagttgtacaaatcctgatagataactccccatgtgtctgttcttctattaaattatgagccccaggacctagtattaacttaaatttggtgtctgaacatatataataatgccattacagaagaactttttgaaatgaatagaaatttttaaacaacagattccatagaacggacattgaaatgcatgtgaattctgggagaggttaggtggcctcccggaagggcacataggtaatggcccagtaagagaatttctgatgttcctgtccgctgctctctgattttgatcttgttgcttcttgcagtagatactgaaagagaggatctaactttgaccataatgagagttaaattttttatgtagccatattaaaaggcaatgtgagacatccgtatttaagataaatgtggtaacaggaaaaaaaagaagtgaaaagaacacagaaaaacaagattcaatattaggaagtgcacataactattgaggagtcccaatagggaaggtggtccttttgcagttcaaaaagggcatggggtggggttggtggccctttcacagttcacacggacattggatgtagcagccatgctcacgtacagtaaattccatctgtgcatggtctaaattatctaagactctgtagataaaaagaaaacttgaaggaactgctgaagaatagggacaccaggttcttaggattgtgtagaagtacatctgggactcatggacttccagagccgggagacaggatggagtttggctgcaaaataggctgatgtgtgaaggatttgaggagagaactgggaagtcttggatatcctacagagagcaggtccagaaccagagctccctactgggaacaccagagtgggtccttgagctgatggggagcagcatggagtctttggggaagggaaagagcttagctggtgtggtgctatcctcagaggagggatgttttgcttgttaccaaagagaacaacatgatgaggaagcaagcacgcaactagcctggaggcggcatgcgctgtgctctgagaactgacaggtagttcacaatcttttgggatccgtgtcaccaacttactaaaaagtgcaaatcagcaagtgccatttagcacatcaaatgaaagcccaggcaattgagagcaaggacaaatgatacccagattggcttttggtgcaacccaaactcaaaacaatggaaacagtgtttctgtttggttttgttttttaaaatgctttctctgtgcattaaatgcattttgttattttattctgacattccattaaaccaaatccagccccctcattctcaatactgtggttatcagggcagatatactcaaaaccttcaaatgctccatggagaacacgtgagggctggagggtgcttttcattaaccttcaccgaaacatcttagctccagcgtgcacgtggaaagtgttaagatgctaatcacttagaggaatgaacagcgtgcacgtggaaagtgttaagatgctaatcacttagaggaatgaacggtcaccgtctctgcctcatcgggaattgtagcgttattatcttttatggaaatgagctgtgcctgtgtttggcactcactgatctagttttgcagtaggcatcatgcaccctctgtcattgagaaagagagggcagagtgaatctgtggatccagagttctaaaacctgaggaagagtatataattcggggagaaagtgattctctataagctctgagaggtcaatggttgacatccttgcttgtaaaagatcggacaggtagggggtgtatcatcttgtttcagacactgtttggaaaaacaaaataaagtggttttatttgaagatgtaggcttggttaccccatagccttaaatcatggaagtaggtaaccatgtcaatttgcatggggagccgcgtgcagtggctcatacctgcagtctttgggaggccgacgagagaggattgcttgagtttaggagttcaacaccagcctgggcaacatggcgaagccccatgtctagaaaaaatagaaaaattatccaggcgtggtggtggcgcatgcctgttgtcccagttactcaggaggctgaggtaggaggatcacctgagcccagggaggtcaagtttgcagtgagccgtgatcacaccgctgaactctagcctgggcaatggagtgaaaccctgtctccacaaaaaaaaaaaagaaaaagaaaaagaaaatctgggtgggatgtaaattgcaatcctgtttgttggtgcaattctgcatgtggctgatatcctaaagtccttcctgactttgatagcatgtgtttcttgaagtggggagtggagaggtctcaacacacacagcccaggtagaatgatcaaatccagaaagtttattctctgtcctactcccatccccatttgttgttgacctttcaggactctttacttctacatcccgggtaggcccttaatctccactggtacccatggtttagcaccattttctcatacttgactcttctatcaaaaatgctccatgtgcttttccacctgggccttgctaaatgactgagacaaatccattcattaaacaaaaagtgtaaggtgggtgtcatgcagtactttcctgagagcatttgcaatttcaacagtagctattggtgataaaacccaatgcaattattaatggtggaaatttcaggcacaaagttgtggcaagacctgatggaagaaaaaatatttagtcacatcgttaaggaataatgaaggtgaggtcacagcggggacagtcttggcaccccttaaatcatcgacaggctgtgcacatcctggaggtatctgttcattctgtgttcacattagagctggtcttgtatcaggcaagtaccaaattacagatcctgttgctgctttctgctttcaaatcctgaaggatttgatagtaatagtgttgaaatgtgcagcgattccttcttaggaaaaactgccataatatgcacaggcatggagtcagtgctgtgggtcccctttgatcctggtggctgggatcctgaatgcagccctccaccaatggctttacaaagcacgttgctgatataatgaagtcttgctccgcaaatttttagtgacaatgtatgtaattattcctttactagtatctgatccatttttaagaaatttaacttcccctgccagaattcaagaaaaactgctttccccagtgtggaactgcacgagactcaagcgtcacctcgagctgctaagttattaatttggaacacaggcttttaaacaatatctgtatgtgcgcccatgtatgtgtgggcagagggggcgatgggagaccagccaaatctgctgattaaaatgggaacaccgtggtgatggcggggctctctcaaaacactttaaaaggccgaagtccatcttgtggacatgctcataagatttctcttggagacaatggtaattcattctcttaaaaaggattggttcaaccctttgagtaggctacccacagcaagatgtgagatcagaaccaaaaaatattcaaagcatattccatgttttgtcttttggaaataatatgtgacagaggtggtcttgaatagtaatgatatatgtttccaaattaatgaaaataagttatttctttattctctagcagtgattcttgaaattcttcattctttttagaatatttgaagttgttatagcattcactctaggaattccaaaattatgacactaagtatgtatctcaaatcaggcctctgagtgggaaagggaaggaaacatatttttaattttaatagtctgcctaatatcccatccacttattagacagatattggatccaaggaagatttttattttgataaacagtaatgggagagccaaggtagggggaaaggagagctggatgggaacagctcaaggtcaggagagagcagaacagtccacagccagggtgcctggacccaaggtgcagccagcggtctgctggagaaaggtggaatgtggctgcaggggcacacagagatggtttgggaaaacagaaacaggaactgtgatatgaaagtgttttgaaagcatacaatggaaaacagcaatgggcttgtaaagttctagaagggagggaggaagtctgaacgtggcacgagaggctcttgcttaagagaacaggtgtttgtggaataggtaaaaccagaggagtgacttggacatcaaaattttattttctgaatgtgattatttaatctaggcatgttttgataggtgaaaaaagggactagaaacttctggctttcaaagagcaaaaagagtttgttatttcacaaataaattcaagtttacctagaagcaacaagatattttaagatatggtatatatatatatatatatatatatatatacacacacacgcacgcacacacacacacacacacacacccttacatatatatgtagtacttcctggaatagcctgagaaagaaacatttaggaagactcaatataattattaatacaatttctggctctgattttgatgagccagatattttgatgttcattttgatgcagtctgccatgcctggaacaccaggtcatatggtacatatgacttggttaaagaagagattaaccaataagagaactttggcaggtaagaactattttgccattaaaaaccatgaagctgtaacaacgtctcaaaagctcccttggtgcattttattaattctttctgctcattactaggcttgggatgatgaagacctgacccttgacttgccaatagctaacttacgggggagttgggagaattgctgtgctttggcatggatgcccctgacttctgatccgagctcctccacctgctagctgagggatattggacagttctggactgattctgtatctatgaaatggggatgattcctgtcacgctgttgctgtaaaaaacaaaatatagaaacacggaatgctgttcttggcatggagatttcaaactattgttcagtgaacacctactatgtgctgacatcccaatgctacttgaatcttcttattttcagcatttggtcagagctcatgtcccatttttaagatgatttgttctacaaaatcatagaatgtttgacttttaaagcttcttatagcccctcttgcccagtgatttttggacttttgttttagtaacgtaaaccccttttccaaagggcacgtcttttccaagattggcatgtgaaggtggtgaacgtgctggcttagtgcccctgagacgtgtcagcagagccccagggcatgggggagcccagctcacaaaccacacatctaattcagcagtctaatcttgcacaggagtaaaaccaagctcagagaggttgagtaaattaccaaaatcatgcagctggcaagctgcaaattcagaacacaactccctccttttttttttcctccaaatcaagcaatcctgagtgaaacgtgggaaatataatatgccaagaagattaacacgaaaactgttaactggcagctgcaaaggaaataaaggaattagataatatgaatgggttaacaaattctcgcctggaggtcagttaagaaaaggtttgtgtcctccaggtaaatcaaacctactgcggtttttcctcttcacatctcatggacaaacacagccatttcttctttttattgcaccagtgctggatgcatgaggttgttcgtagcaatctgtcatatttgagtaattcgttatttaatgagttgcttttgaaacaaggaaaataatgaggatgttaccgttgtgtatctccccaatttttaaaaggaagcaacaaatagtaaattatgcatgctttggaagtatgcagtagttaattttcaatctcatcttacagctgaataacctcaaaggtagtagttatacaacaggtgtgggaatatgtgagtgtgagggagaggaatcccaggacatcacctgtacacattgggggtttggcccagcagggcttcagatgttgaaacatctggaaattttatttgctcacaagcttaaaatgaaccaaaagtatgttgcttattaacacttttgaggatctgatgaaagccataggactgcttgccagaaaaatccctacaattttttgagttcctaaggttcacattcccttcatttctgtctgtggactccaggttgagcgtctctgtggtcaccatggtccccagcaagctagcacagtcttaagacacatcagtaggaatgtactcagtgctcaaagcttacatagatattgaccagcagccatcacctctggggggctgtgctagggaggcacagcatgtagaagaggctggaatgggccagggagagtggtaagggagcaatgggtaggagatcccagaagtggtaggtaatggaccgtgatccatgtcaggtgattaaaggctaaaggaatatggttctgtcctcaaccacatggtggcctcagcctgggatacatgactgtgtcttcctccataggggtcagtttaactaagaaccccaagtattgaagacctcaagactttaatatggtacttcctgtaccttgacacacatatataagcttctgaaggacacaaaacatgccacgttacttgttgtatctctgacgccaagcacaatggtgacccacttgcttgtgtgctaaatgaatcagtgagtgaatgaattgtgtcctcctctctaaacctcctctactgagttatacacaaagttgagggtctgtggttttactatttattcatcgaatgaaccattgaacaaagtaatcaaattttcagagccctgtagagaaatcaaatctccctctgaattgctaactcaccttgctttccctattgtttaaagtgtcatagccactcttcctttcccaacactccaccctcacctgtcctacccaaaaacatttctctgctacagaagcatgaactattcactccagccaccagccatgcatcaacattcagtcttgctgtgattcatctccataagataagtgaatattctctcatttaccaactgtatagataagaaaaccatcagaaatcaaagaactgttgaaaaatgggcattttacatcaccaaagcccttttttgttgttgaaacagaagcttcaagtcttctccatccactgaaatgagttgttgaagtggaaaagtaagttctaattgaaccaccttctccgatgcagagaaaaagcagacttgaacaattgggttgatcttctatttctcaggttggagaagtgctttgaggaaagaaagatggggaatcaagatcagaggaatgcaaagttctggaatgtttgcctcagttgccctctactgggtctggcttggggaagtttgtagaactttttaatgagtcattgtaggttcaggagagatttcagatgtgggggacagggtgaaatgctttcttacacagaagtgaatgagttagtgaaactgtagcacgtacagtttgggagaatgggggcaatggggggattgtggtacgggagaaggagcaccagcctgggattcagacaggtctgagtttaaattccagctctggcacttgctaggtaggcagcgttggacaagttgggtaacctcagtttccaccttgagcaagtgcttgactaataacagctgtgactgttaccagtatggtaattacagtatcccaaggtgtaaagaagcagaagcatgattatatgagttgggtcaaagatttggctgtctccctgtccccccaccaatctggctacagggcagactttgctaaatagacacagatttacttccaatgaagtgggtttgctgcactgaataaagtagtttacttttccttcactgcagctgtgcttgaaattggacagaaagccaggtgtggtggctcacgcctgtaatcacagcactttgggaggctgaggcgggcggatcatgaggtcaggagattgagaccatcctggctaacatggtgaatccagcctgggcgacagagcatgactctgtctcaaaataaataaataataataaattggacagaaaataagatagagttgtagcaattagtctgcagtttttgactttattaaattcacttagacatgtggctgcaccattatgctaaggtacctgaggctctactatggtgtattcattgtcgaaaatgtgtttgcgatgtagatacttctttcacctagttctatagtgatactattgggaatctgaagttgtcaagcagctagtgtatataattgcatgtaaaatagactgtattttgtacttattgaaatctaatggtgatacttggttttagattactgaatgtagattctgaagaattatggccccagtaatgaatggatgtgtaattagaatttttatcattattctgtaacatctctgctgaaaatttcaggtttatataattgttttggcttggcttgaaacacaaattatacttaaagtaacagacagtaattgagaaaattatacttaaaggaacagacagtaattgaatccaataaaaacaccaaagaagatcaagattgctgtgagtggagagtctggcttgtatattttgcgaacctcatggcttgaatgacatattctcaacaaatgcatgccaagtaaagaaaatactgactttatgtttttgattcaaatattcatttcatgaaactccaaataacttttagtgatatggtagtttatgtgttgatccagtgttttaaattttaacaatatacagagaattcctaattacactggagattttgaaattttcaaaaaataaaattttgtataagctttaccctgtgagggaatcctcacttctggtctcaaatcagctagtgttgggcattgaaaatattcacagagattatgtattaattatatagttgtacttagaaatgtatatgagagttgttaatgacataggactcaatattcgtctccctcgttctcactctttgtatgcttaggaatgccaattacttcctcacattatcctgtaaagaggtataatcgatttagagataatgagagtgacctagggaaaaagttattaagccacaaatcaattacaccctatcaaccacaccctcacttgctctccccacctctcttccagcccccaaataccaagaccaaaagcttggaatcacttcatggaaagtcctttgaaaatgatttgtacactgataaaacttcttggaaacataaatcccttgactgatacttgttgagcaagttaaagatgtcccagttcacacctattgcaacagaaccagaaatcactgaaagaggctaagttgtacccgtaagtttggaatgcagagctgggtttctgtcctttgttattcaggatgtatttctttctttcttgggctcagtaagtagagtgtagtaacagtgtaatagcatttgtgttcccaccttcccacactataccccaccccccccaagccatggcatgagcttatatgttagagaaaaaagaaacagcttcggagaacctggccattcgagggccatgctgtctggtagcttctgtgttggcagtgaggatcattgatgtgggtgatgggcttatgcccaggcatgtgtgttcttcatccagcctaccctcctctgcggttctggtttagagtgtgttggtttggggcagtgtgatgatctttatgtggcccccagggccagcagcaggaggtgtctgccatgtcaggggagagtaatgaagtctggacaccatggaatgcctgtgtgcagcctctctgcgcttgtcctcatgaacttctccaacagtcttactgatttttttacaacaaaaattatacctaatgattatctatttcatgtacaaacacaaagaccattttactgttaggattgaaataaaactttttttgtcttcaaattgttttgctctaacacaggcgagatttttatttttaaagacaaggttaaaactctttttctctgcataatttcagtgtctagaatagagtaacagtcctgctttatatttgtataacgcttagcaccagtgctaacaaaatgcaacatgagactgggcatggtgattcatgcctgtaatcccagcactttgggaggccgaggcgggtggattgcctgaggtcaggagttcaagaccagcctggccaacatggtgaaaccccatctctactaaaaatacaaaaaattgctcaggtgtggtggcgggtgcctgtaatcccagctactcaggaggctgacatgggagaatcgcttgaacccaggaggcggaggttgtagtgagctgagattggaccactgcacttcagcctgggcaataggagtgagactttgtctcaaaaaatatgcaacatgccgggtgcagtggctcacgcctgtagtcccagcactttgggatgctgaggtgggcagatcacgaggtcaggagatcgagaccatcctggccaacatggcgaaaccctgtctctactaacaatacaaaaattagctgggcatggtggtgggtgcctgtaatcccagctacacaggaggctgaggcaggagaattgcttgaacccaggaggcggaggttgcggtgagccgagatcacaccactgtactccagcctgggtgacagagcaagactctgtctcaaatatttcaaatatatatatatatatatatatatatatatgcaacatgaactactatgtaatttaaaaattttactagccacctttaaaaattaagaagaaacagatggaaatgattttaccatgtattttatttaatctaatatctcaaaaatctattattccaacatagaagcaatataaaaattgttaatgaaatattttacgtttgttttttccactccgagtctttggaatggcatgtgtgctttacactgacggtgcctctcacttcaggccggccctgtgtccagtgcggtctccataaaggactctggtgtccagaagttcccatggccgctccattccgtacttggttttcacaaaaactgtctcctaccttctaatgtcctcaattctacaggaaaatgagaatcatctccagacagtagaaactgtatccataatccatattatgaagagataaaatagccaattgtactttgtttttttttttgttgttgtttttcttgagacagaattttcctctgttgcccaggtcggagtgcagcagtgcgatctcggctcacagcaacccctgccttccagggtttaagcgatccttctgcctcagcctccctagtagctgggaccacaggcatgtgccaccatggccagctaattttttgtacttttagtaaagacagggtttcaccatgttggccaggctggtctcgaactcctggcctcaggtgatccgcctgcctcaacctcccaacgtgctgggattacaggcgtgagccactgtgcccggcccctattgtacttctgtttgaacttatattggcaaatgtagtaattttctagagttttagaggaggtagtgtttattattataaatatttgctgagaactttctgagcaaagggtactatttattctatataaatatgtactgagcatctgctagttatttaacagacttctaggcacaaaggatccaatggaaaaaataagaatattcatatttaacagcttctttgtgctctaggcattgattattctctgcattgatagaatttacacttgcagctttcaccaaagaaaatgttccacagtttaggcagcatggcaaaaatccatctctacaaaaaaataccaaaattagcaggtggtgcatgcctgtagtcccagctactcaagaggctgaggtgggaggatcgcttaagcccaaaagatcgaggctgcagtgagctgtgattgtgccactgtgctctagcctaggtgacagagccagaccctgtctttaaaaaaaaaaaaagaaaaaatgctataattttacaaaacctgctctccatgtatccctctctactctccttaagatgaacactgggtctggggtgcaggggtgccacagctggagttgaagaggaagttaggagaaggctaggaaccatcacggagatttttcaccctggttccttcattattacttgttggggatcagtgaagattagaaattgatgatggcggccaggcgcggtcgctcacgtctgtaatcccagcacctttgggaggctgaggcgggcggatcacaaggtcaggagttcaagaacagcctagccaatatggtgaaaccccgtctctactaaaaatacaaaaaaaattagccgggcatagtggcgggtgcctgtaatcccagctacacaggaggctgaggcaggaggatcgcttgaacccagaaggcggaggttgcagtgagctaagattgcgccactgcactccagcctgggtgacagagcaagactctgtctcaaaaaaaaaaaaaaaaaaaaagaggaagaaattgaacatggctttacagaggagcttctcttccctgcaggtagcggccttagacccttgtctaaggcaaaagtgggatttagggaaagatactgtggtagctgacacagaattgcaaaaggctgaaaacccccgccagcgaagggcagcagctgctcccctcctgtgggcactctattgccctcatagagagaaggcatctcccagcactttctacaaccacacccccaacccccaacccccaacccccagcttagttctctagaagagcagaccctcaccctcccccacctcctcagcccagcctggaaaggcccacggaaggactctgccagccctggctaaagttatgtgtccacctctagagcagccacctggcctggggacgaagcagtatgagcccacattctgagttgtaaaaccccacaattaggaaatagacttaaagtgctcccatcacattaggatgcaatgtgcatttttgtttgtagaagcttgttctccatttcttcttatttgggcaaaataagctcagtttgactaactctgccatctctaacccagaccccaccatgctctgacactttgacaagcacactggatgggcaaaagagtcaactaccgaaggaagacaattttcgtttggtctaaaactttatacctgtgatattctgtgccatggagagactcgtgcttaataattcactttccaatgatcttaggcaatgtagaagattacaaatactgtgagacctgaactcctccttcagggaacttaacagttttcagtggcgggggaaataagagtagattcctgaaaccatagcagcatccgatagaacagaacatttcctcgactctagcaaatctcttaattccaggtgtactcgggaagatagtagcatttattgggtatatactatgaagagagaagtgtcatatcctgagagggggtttataggcagtaaacattgtagtctttgccttcaaggtgtttgaaacataaaacatgctcacattagctaaatatgcctgcttcaatgcctgtacttatatcacacaaccgacgttatcaacctggtttcaaacgccatgagcaaaaatcaaatcaggtaatgtgtgtgaaagttcattatgactgtaccaccatacaaaccgagatggtattactccagtcagaccttctgttttatagtgtgttccagaagctggcctggttgcagaagagagtgagctcattagccctgttcaaaaaaaaaaataaatggaataataaagaaacttcaaaaccaaatgaaataccattccatgcacatcttggaaaagtttataacgtatttaaacatgaagagctattgtaagcttgacaataaaactgtgaggatattgttcatttccgagattcacttttccaagatagctctatcgtgaaagtctcttttggagtttatgtatagttctttaaattggcacagttggcttaaagctaaaacactgtagtttgcattaaaaaagaaaaaaaaaaagcaagtgcttttgcacaaaaggctgtaagaaatgagggctgcatatgaagcgagtgttccgttgactgtgtgagtgtgagatccttttggctttagtcatttatttggggcaagctccgaccttgatgacagatgatttcgtcaagctctccacaaaaggtacatgtctattttcatcgtcaactaacttctgtggagcacttgctgcttttggtcccctaaccatgaggttttattgacccatttgccatctctggggtaagtggatggaatcatctttcttgagaggagaactccaggaataatattacacttgtctctgagccatttgagcttgctatttttacagatttcagccttagttccttttcctcttcctctgtcaccctcagaacactgggacaagggggagccatgctgtttcataaacttcccatagaggttctgagtctcctttttagctgattcccatgagtttgtaatattttgatctgagctggttgcagtttgaaataaataaaagcaatctgatttcattctagccaacatctgatgggtttgatatggatgaaagctaatgagaggtacaagtgagacagtacaggtgaaaactacaaaatctctcttgtaaaatacacatatacgcagacccatattttccaatgacacttaaaaggagtgataccaagaggaaacactgagtcccatgaaacatttcttcaatcaggacagaaccatgagcagaggacatagtgggtggggttcgtggaaaaatagaatatatatctaattttctgtttgatgatggtctacggattgatttaattatgattactacagtaacttgcctagtacttcctgttcacggttgccttttacatgcacagcaggttgcttggggagctgatgtctgctcctagcctttctgctccggtaccctttgttctgttccattatgtttcagataatttaatcaaagttgtgtttgcttgtgcgctcccccctttgaatcattctcactgcacttctgccccttccatgcagatgcaggctgatgccggatgggtctccactggcctcttctctggacttctctggggcccgtatcagaacccaaaacctagcctcagcttgacttcttcctcttaccacggggtgaccccggtgtgatctcccctcccaggttccatccagcatgaccgccgggtctccctctgccctacttgattgcactcaccttttgttaccagtccaggcagcaggctccatgtctgggttgggggtgtttcctggcctgacggggcaccttgttcgtttcacccaggcaggaaatcacgtcttgtttcaacatcctgaatcttgtcctgacgtggaaaccgtgatgctagctgacctgacctgcagcctcaggcatccctcggccctttcatggcctggtgtttatgtggtccgtcctcacaaactcttaggatgggatttattgtctccattttcttttctttctttctttcttctttccttttgttattttttttttttttttgagtcttgctctgttgcccctggatggagtgcaatggcaccatcttggctcactgcaacctctgcctcctgggttgaagcggttctcctgcctcactcagcctcccgagtagctgggactacagatgtgtaccaccatgcttggctaatttttttatatttttagtagagacaaggttttaccatattagccaggctggtctcgaattcctgacctcaagtgattctcccaccttggcctcccaaaatgctgggattacagatatgagccaccgtgcctggcctacagtctccattttctataggaaatgaaagcttagtgagagaaggtgcccagacccccaatggctgcgaatcggcagagttgggccccagtgggtctcctcactccatcccccttgtaccacccagtgtctcaccagccattctgctcagatgggatgtagggcctatatagcaaatagaagttttctgggaaccccttaatgacaaaaaatacttgctttccagagtattcatggcaggccttgataatcttgagcctcaagtgcccacaattccttctgggactgactttaaacctttatttcaaatacaagctgggtcttcattattctttgttgcaatggatctctttacacgttaccctcagaaccacaaattagcaagagtctagctggaatctctcctgtgatggaaatttcattccctaagaaatagagcaacctttcttaattaggcatttactctaatgattcagaaagttggttctttatttttgctttattttcattagaaactaaagatttggatggtgttttcataatctattgagaactgcaccaagactgtcagtattcaatacatatgattaataatcagagggaagacacttatattttctgtcatacacacatacctaaatgtttaggccaagggcacatttttaattgattcaaatagcaaatataaattgtgcctctctgttacctgaatgtcttacttttttggaggttttgttgtcaggaactgccatataagaggcatgcatcattttaattgaatcttaaacctgacacttttattgaccaaaaaaaaggatttcaagttatttttcatgcataaagcctgcatgaagcctgtacttctttagtgaaggctatctcagatatgtatgaccttacctccttgcctttaggaaaaattaaacctcactgtctgagatccttgagatttggcaaatgttgatcaattaactcttcaaagacttatgatgaaataactgtaggcaataaaacatactgaaatatgtccaaatgaccagcacagcaaaatatgcatgaccctgtgcctaaggtctgtggcatacaagccttgggttctgtttatggggatgtcaccttctatgactcaggtccctgtctagaaacatgatatggccacgtcttggtggttccttatttatgcggtcgagtcttttgtattcttaagtcatctctggaggataaaagtcagagctcaaagtctatatatactgtcacaaaacaaggatgcagatataatgatgataaaattgaacctatgatttaagaaatgcgatatgaatatgatatgacaactctacctgccaccagtggactaatttcccttgttgccaggggagacctcatcctcatcctaatttacacagtgttgtatgtttgtcaagaatgcataattctgccagtctgttgtatttctaattttagcctgtatacatagaaacactttaaaacatttgcaggctactgcaatcatcgtcatacaatctgtatagttgttacatagaaataatatcagttggtttccccataataattttttctagagagctagctgttcaatgctaattcatatcctttcttaaggtatatggcaagtaaaatggatttcctcggggcctggaaggaattcctgttcaatgattggaacatttaaaagatttcctcttgatttcctacaaggaaggaataggaaagggaggtgattggtcttgttagcctggaaatagtattcactgggtcgctagagggtgggcagagagggacgcaaaaaggcgtgtgtcagagttcctgtctccggggaggtcacaggatcgttagacagataagagagacgcctgtgtctaggtgtctttggttcagtcctaatgttctgcttggtgtctggttcccacaggtcatttggggggtctgaatggtgatggatacctctcagagaaaaaaaagatttaggcttccaggcaaagtggagaatgaagagtaaagacttggaatgatgggtggcaggataaaatagaagaatcattagttattagaattattagggtaaaaagccgtgttaagtgctttgtaggtaggaggaccgtatatcccaatttgcttaggccagtcctggtttatggcaattgccctgacttgagttttagtaacattcccttttattctcaatagcgtcccagtttgggcaataagtcatatggtcaacatatatattgatgaagaattaggatcttaatataggaacagattgcgagtgaagataaaggtaaaatcaattttgaagtccccttatactacaccgtaatttgatatctatatcaatctctaattttacttgaggagtagtgttgacctcatgtcttagaagaaaaaaatgaaggtaaaaaaataataaaattttgcttaggccgttgtgaaatttcctttcaaagacggaactagaatttagaactcaaaaacctcatttcctatactaacccccaccctacattgccggggaaaatggaaaaagcaaaagaaataatgggatataaaaatgtatgggacacattctttcctctattatgagcttgtctcttaattaccaccatttatactggacatgtgatttgggtttccagaatagtaaaaacacagatattataagccctgtgatcatttgcaaagaaatctcatttgcccaggctattacatttctgttctgccttcagtggaaatacacatagaatggaatagaaatatgcattactatgagtaattccagacaccttaatgcttttagcgggagtgcatttggagtttgtttcctgagacccctctggtggaggtggttgttattcatgcttgctggaacagtcctccccacgtctgtgagctcaagcaggtcctggcctcagaaccacagaactccaatagccagagactaaaagaaaagggaaaaatggtttgctcggatccctgggttgcttggcccacaccctgagtgtaatatgtgatcagggttagaaagcaagtggtgggagcaggtcttgcttctgtgggcatggcctcctagagaaatagtccagcgctggaggcacagagaggggaggacaggcattccaaggctcttgaagaactgaaatctggaatcgacatgaagctacatcccgaagcagggaagtaacgacgggcctggaagggattcctgttcaattagtggaatatttacagaagtgttgttttgaagatgaatttatggatgatgttcatgtaaagtgagatagaatgaggggacagacagggatagggaagcaattaatttgccatagatgtgggtctgaaaataatctttactggcttgcctggtgttgtctaaagtagcaggggaagctttgagaatcctattgatttcaggttactatccaggaactataaaatattaaagcagaaaggagacttagtgatcattaaattcattctgaaatgagaaaaatcaagcccacagaaatggagggtttacttaatggagggtgtacatggtattaggggcaggaaccaggtctagaacacacccactggctccttgtcattaaccccgttgccctggagagaagagaagccggtggtcacactttgacagacacagtgtgggtgatgccagagccaaaaccttgggaagggaactgtgtggcttcatggacatgaccagatccacagtcatccactgggttactgtcttcccagttctcatcagccagggttgtttagaaacattgaaaaatgttgctaactgtggatagctctgtaagtagggttttccatctttctaacacttattacatttttttattcctggaacaattttgaatgagaagtggaaaccatggttttagccctacttatctcttaaggaagaatagattggaacagtacaggtgttttgcttaagtttgtggatttacttaaatattccctatgaaagctccggtgtacacatttattttattcatgatttcaacaaagctttactgtgcaccacatacagtccagcatggtcccatagagctttcagcaatggtggaattgtgttgcatccgcactggccagcgttgcagccactagccacatgttgctgtcgcagtcttaaaatgtggctggtgatcagggacgatgagcttttctcatatatctgttggctgcataaatgtcttcttttgcgaagtgtctgttcatatccgtcacccactttttgattggcttatttgttattagagaaatgcaagtgaaaaccacaaggagatactatctcacgccagttagaatggcgatcattaaaaagtcaggacacaacagatgctggagaggatgtggagaaataggaacgctttcacactgttggggggagtgtaaattagtttaatcatggaagacagtgtggtgattcctcaagggcctagaaccagaaataccatttgacccagcaatcccattactgggtatatacccaaaggattataaatcattctataaggacacttgcacacatatgtttcttgcagcactatttacaataacaaagacttggaaccaacccaaatgcccatcaatgatagactgaataaagaaaatgtggcacatatacaccatggaatactatgcagccataaaaaagaatgagttcatgtcctttgcagagaaatggatgaagctggaaaccatcattctcagcaaactaacacaggaacagaaaaccaaacactgcatgttctcactcacaagcgggagttgaacaatgagaacacatggacgacacagggaggggaacatcacacactggggcctgtcgggcggtggaggggaaggggagggagaccattaggacaaatacctaatgcatgcagggcttaaaacctagatgatgggttgataggtgcagcaaaccaccatggcacatgtatacctatgtaacaaacctgcacgttgtgcacatgtatcccagaacttaaagtaaaaatttttaaacatgtggctggtgactgagagatgcaattcttaactgtagttagttctaattaattgaaattgagatcaccacagatggcagaggctttcatgtcagtttcagactctggtattgggtcgagggagaaaagaaaaaagacaagtcatgatctctgaggacaaggtattcacagccgagagtggcagggatgaggagagacaggtaaacaattgtcacactggagtgtggccagttatgtcactgtgggaataaggtcctgtgagagcacggaaaagatgagcgtgatatgattcctctttggggcgggcaagcatcagggcagtttgacaaagagcagatgttcctgtctttacgaacggactgagaccgctccagacatctgagatgaacatgaagagaaaggaattttcaacaatggagcaaacatacattctcagcagtgtaaagagcagagcgccagaggcaaccgtgtacttctggtgtacttctgcgtgcacgttggtgtacacaccctctggggaggtgaactagcaggcagcttggcaagaagtcgcctgcggtgttctgcgtctcagcccttgttcaccatagtgctctgtgtgaagttggacaaatgcatctacctttctggacttcagtctcctctccactccccgaaggcagggcagagcagctgtatgactccttctcagatctgggcttagtccttacaagcttctgttgcattctccagctcctgcagtggccttccctcaagacaatgagaagcttcttggcctcctctttaacactgggtgctatttaatgagggcacctcaagatcctcccagttaccacgattgctggtggcagtcatctcccctccgacaacagttttgtgctctgagtgcctgtgctgtttccacatttttttctccccctcaggtattttagaccccaaagatacatgggtactctagggatactgtgtaaagactgggtagtatttggaactggcagccagagagacgacattggcaattcattcatctatcattacctcaattggcagtgttctcagtacgcagggactgtctctgtgtggctttttgtgagagggatgtaagatttatttttctctatgacctacctgctggcatggtacaaaaggtctctgccgaggtctgagggacctcacttgagctgcactaatagacggggggataactggtagaccaggagagtgtagacaggaagaaagaactcacctttgtaaatgagccactcaggcttttgattttgtggcccttgaattcccacttcagctgatggtcacactcatctgtggggaagctaattttacaagaaatggaacaggagggggttgctgttggatcaagaagatgcagctttggaaggtatccacgagggaatagccatcaatttgccacgtgtgtgagctctaccatcccgcagcacatgggagcgtgctgtgctgtgcctgtgtgctctcaaggtagacgaggtgtcactatatggtcatccacacagcaggtgtggccaaatatagagatctcgtgaaaaactaatagcctgccaaagaatacagccactttttcagggtcgtaaaaacactctgtgactttcccaaaatacagttactatacatgcactagcaaatcccaggatgttctcttcttatggtgcacatagctaaatacccacctgtggaatgtgggtttatttgggaagaagctaatcctattaggagtttcatattctcaccaatttgggtgatggggtctgtgaccaaagatcatagaaagtaagaaatacaggactcaaaaatgtgttcttcattatgtcttcacctcgtgctttttaaacttttttttttttttttgagacagagtctcactctgtcactcaggctggagtgcagtggtgcaatcccagctcactgcaacctccgtctcctgggttcaagtgattctcctgcctcagcttcctgagtagctgggattacaggcacatgccaccacgcccggctaatttgtgtatttttagtagggacagggtttcaccatgttggccaggctggtctcaaactcctggcctcaggtgatccacccgcctcagcctcccaaagtgctgggattacaagcgtgagccaccacacccggccatggttttcaaactttaatgtgcatggaaattactggaagtgtttgttaaagtacagatgctgcttcagctggttgggcataggtcctgagatcccgcgtctctcacgggctcccaggccatgcagttgatgttggtccatggatgaccctctgggtagcaacgtttggggtctttgtgtgtccacacatggtgtgtctgtccattaggaggaaagtgccagcgcatttgccaaagcgtttagataggagcctgttagagtttgaagttccaggaccaaggaaatctggtaaataaaggacagttgtttgttcatggatctaggtttataaagtgtgtatacattttgagattctgtctcccccctccaaccttaaaattagcaaaatgtagtctttctttgtcgagctctaggaataatttttctgcgtcagatgcatttttgggaaggtgcgtttggccatttcccactcaccgtgcccgcccagtatccctgcagtactttggaagcaccataattgggaaagagtagaaagttcttgccttggaaatgagattcttatctgggtcttgggcactggaggatctcaggcgcgggaggctcgcgatgggtccggggaacagctgctgtgttcctgtaggaggaaatgcctgtgatggaggcttctaaagccagctcccgtctcagagaagacagctctatgcctccacgtcgtgatagcaaatgttcccttttggctgttttaatagttctgcttcaagcgtatttgtttttccttatttcctagcatctttgagaaagatctgttctatactctgtagcccagtttggagagatatgacatgtttgactatgtgaggaaatatacatatttctcagggcttttttttttaaattgagtgttattggactttgatgtttgatttccaggcagtctttaatgtgaaaggcaaacacattcattttctatcagttcctgaaaatgttcccaattttagaagctctagactggtcttgccaatatagcaacatagtgacagttactcgtctgtaattctgtacttaaatcgtgaactgctagcactatcgattaatgctttatacagtttcaaagctgtactcccaggctgcatttagatggtttaaagcattgatttctctctctgacaactcttaagttattggctgccaaaaaaatgaggaaaggttggttaatctccatggctcatatgttgcttgctgtagagaatattggtgaagcatagtttttcttcattgtaagatgcactagggatgtgaagactgttttgaatcattgtgaaaactggaatcagaaaaacaatctcctcattcaattcaagaattcgagatccaaaacaacattcagtttggtatttggcagtttaaccaatatctgactttatgtaattttaattattggggtcagccattggtattgcattataatttgtaatgatttatatcagccttttaaaaatgctcacagtcatggacaaaactggaaaaaatgaggaagtaacccaatccaaattacttaatatcatctgctgtaattagaaattagattttagtagactgtttccataatacatttcagaattatttttataacttaatagtataaatacaaaataatttcagctttgttattttattatgtgctgtgctagtttaaattattccggttataggtgtatcatcaacaccttatcttcagcaaggattttaaatatgggctgaccaaatttatgtggaatttgcattttgttattcgtttaaaaacatacagaaaatggaaaaaaaaaaaaaaacctttgcaaagattctcttttgagtgctagcttttcctgatccctaaggatgccggctgctctgccaggaatgtgcccttcatattatatcttctagaatgaatgtttggaagggaaagcagtaagatgcaaaagcaagaaggacagatgatgttcatactcacagtaatagctgtctcccctcttatcagttgtgatgctggaacaaacacctctttcctgactgcagggtttggaggtccccaagtccaccctcacttctgccatcaatggcaagcggcactggctgcgtggaaaagccaagatgcctttcaccataccatgtctggagtctagttgctgctcaataaaccctggtggcgatcactctcgagattcagtaacattatccagaatttaaaaaaaatacaagcctgggcacagtggctcacgcctgtaatcccagcactttgggaggccgcggtggcagatcacttgaggtcagaagttcgagatcagtctggctaacatagtgaaaccccatctctactaaaaatacaaaaaatagccaggcatggtggcacgcacctgtagtcccagctactcaggaggctgaggtgggcgaatcgcttgaagctggtaggcagaggttacagtgagccaagattgtaccactgcactcagacctgagcaacagaggaagactctgtctcaaaagaaaaggaacagaaaaaaaaaatacaacaatgtgtggtccttgtattcaagccaagcttatttctgcctcaaagcattgtgccaagtttgtatgttacttcaggtttcataagccagcagatcctcttcctgggactgaaatgatgatttcagttttttcaatgcttaagcgtggaaaacaggcaggtaatttgtgacccataagggaggggtgagaaccacatgaagatgaaggtggtggaaaggagcagctgatgtcacgcactgtctacttaacattgccacgttaatgttaatgccggttatagaaagcaatgggtaattgccatatttttgttacggcttattgcagtgaatgcaggatgcttctcacatctcttacacatcaagtaagagtatttcttaaaaaacaaaacaaaacaaaacaaaacaaactctcaatgccacatatacctgaattgtgagtacttatttcacctaacaaatacctaacaaatattgatattttgccacttatgggttgtataaatgaccattaatatgatttgtcaggcacagtacacacaactaacctataaacaatgtgcagacgtaggtcataaactgtgacactcgaaatccaagtagtgcccctggtgggagatgtttcacatgttaataagcaattaccgtagtagattaagagtacagaatcaatccaagaagccaataatttagagttggatactgtagcacaagattgcaggaacctgagtgctgtgtgccacgctgcacatcagaggttgcaagatgtcctgcaatgcaggctcaggaaagtgactgatgcgctgtgttctaatgtggaattctacaggtattcgtggaaaaacatcaatacattagcaaaacctggaccgtttctggtgttgctggtgctgcatgggatgagtctgtggggcactccatgggatatatttaaagaggtgttattttgtctcaagcggctagggcggagatagagcatgctatttgccacattgcattctaggggttgcaagacatcctgaaatgtgggctccatgaaagcggttcatgctgtgatctgtacccccagatctcttcccaggcaggtctcatccaccaccagaaatggtccatgttttactactgtattgatgtttttccacaaatacctgtagaaatccatattagaacacagggcgtcagtcactttcctgagcctgcattccaggacatcttgcagcctctgaaatgcagcgtggcacacagcactcaggttcctgcaatcagcatgcccacatggtcataatacagacttagcaacctggaaggaagtctcagtgatctgtgacccagccctttctcctgatagaccgtggaactgcaggcagaagatgcacggcgtctcatctcagatacacagtggtggtgccgggatggtatgtgctctccattctccctggagggctcttggtccatcttgcttcagtgactagcatgagaggagtggtgatagcagcaggtgccgtggccactgggcaggcggggtatggagaacgcagccacacggccgccactcctgctatggaggcaccaggtcccgcaacactggtaccataggacagggcttcctggtatcacaggatttgccagagctggaacgtaacgcccacttcacaccttggagtatgattcaaagtagagtttgtagtgaattccaaaaggcatgtgattcaagctaactgccaagaccattcagagttgtggggagaaaaccccactgtgggcacgtgagtcagggaagcagcatggaagcggcttgggtaggattgtggcaactggaagggagttgggcgggccatggttacagatgcgggaagtggtcggagtggggaagaggacctgtctgattcccaggaagtgggcaggctccatgcagagcaggatcccccgtggagcctacacagccttgcacacctgaactgaggggcaacgaagaaggggtctttgtagttcccttggttaggcaagtcaccagctggaagtggcagccgagacccggcagggacaaccctgtctttcccagtgagcatctgatgatattatccggggcccgagcagctagggtagaaaaggagaagcatttaaacatcagtgcctcaaatctcctttccaaacatcccaggtatagaaagttacatcactcttgcaatttggttcatcaattgtcctcactgcaaagttgaacctaaactaactcctgttgggaggcagactagggacaagtgactttcagtgatgctgaactgtgaggctgaggcactggccatactgcctcccaaatggaaccctcgtttgtgcaaatgcccccggccagggtggtacccacacacatctgcacatgactttctcagtctcctcctaaattatccctattctttttgaaaacataaaattaacccaggtggaagtttgtgttgtaaaacatggagtagttttcaatattgtaataggctcttcaagaagagcagcatttgcccacaatctgaatttttagaaaacgtctaaaatctcgagttatcagcaggacgatatccacacagtagatacatccctaccggactcagtggcaaattatgacacaggccaaggtctatccttgcaccatctgtcatttctgagtcttcaaagagctcagagatgtcctctgtgtgcctccttacccaggcaggcagcctaaactcccagggttcttcccaggcagatctcagccatcctgggctcaggaaggcattccaggaaaccagaacgcaagggataaaagatggaggaagtcacctcttttagcagagtttgcactttgatgagaatgaaggctcacgcccagggagaaggtggataagagagacgtttaagcaccagctctaaggtagttgcagtttgctgggctgatttgggtgctcctgaaggatttgttgtctggggactcttgcctggtgcccaaggctgtaccttcttgcgcgtaagcctgttcagctctcggcccgtgtggcatgcaggccacaggagaaggtgactccagcccctcctccgttgactgcatttctcactgagcgtatatctgtcttgccttctcgcagattgttttcacgtggcatttcacttaactttagtctggattcacattttttttttccagaaggtgagattcttcttcaccaagatgtcacagtttgggcaaagttcaaagttgcttaaatttcttcgaagggctccatgagcagttgtactccagcaggactgtcactccaaattggactctccagctggtcaggggcggctttccaagaatcttgatgtcccagagcccctctgatacagtatctgaaaggccttttttgaatgtttggaatgctcttgtctgagagatatcttaatatgaaagcaaatacctgaagcataataaaagcttgtaaagcatcaagaaaagaaacgatctcaggaaaacctaatagtaactcgtgatccagggacatataaaactggagatacaccgtgaaataaaaaatgtcaggtacttaacagcatgcaaatgactgaagccaaaagaaaaagaaagaaaagaagaagaaccaattaactatgagagtctgcatccttccccagggccagtgttaatttccatcgctgtctttaagcacatcgttttgaaagagtgtgctcgggttcatccatcttatttcttctgttagcctcagaaagggagaaagtaattttcctacattgtcagcttctttacaaatgtctgggccttttctaaacagaacccccattgaatagaggaaaacaaccattctcacactgaatgccctctttaaccctaaatgcttattcagtcatttagcacctctcttcctcgccttttttcccttctgaacatgacctgaaagaagatgttggaacccccctgcatggcggcgggtggcattgccctgccccattcatctgcgcgttcatccgtttctcttacggagcagcctcaatgctctaccgatgtgcgggtgccaatctgtctccccgaggttattcagcatctaacgttgctatttaatctccagatttctaaacttgcagcagactggctgtgaacaggccagattatttgtttcctcttaaaataagtgcttgatggttgggttgtgtggggccggtccttggtggtcactgcatgtaatcaacattcatagactgtaggaaaatgtggtttaatgaaacattctgccactttttcttctttggcacgcgttaagcagtgcgtgcaatgcattgcaaatgcaagtaattcagagtttacaaggaaaggaaggagagtgaggaaccccagaggacagggacgtggggtggtgggacagggcttcaggctgatttatctttcatacagtagtttggccagtgggaacgcggagtgggaggaggctgtggctgcctgctcttcccaatggggaggaggctttacggtcctctcagcggagctggtgtttactaaaaggtctttcctaaagagcccaccgaatagaaaacgtctacttcccgtaggctcctgagaagcttcctgaagtcagtgagcacgttctgcataaaagctcatttgaactctgcactaatttgcctagcaattcataggaatcaatcatctaatattcagtccccatctaatgaatggctgcttaaacacactagtttttttttttcattgcattgggttaggaagtttgcagctggtaaattaaaataggaagcagtctttggtatgaaagtggcatattttaagtgccttggaatgcacttgttacaagtgctctgctgttatgtgagcagtagtttaatgtggttggctgggcgtagtggctcacgcctgtaatcccagcactttgggagcctgagatgggcggatcacgaggtcaggagttcaaaaccagcctggccaacatggagaaaccccgtctctactaaaaatacaaaaattagctgggcatgggtgcacacgcctgtaattccagctactcgggaggctgaggcaagagaattgcttgaacctaggaggcagagtttgcagtgagccaagattgcgccactgcactccagcctgggtgacagagcaagactccacctcgcaaagaaaaaaaaaattaatgtggttgaccattagaaacacaacatcaaaattgttttggagccatcttagttggttaagattgatgtgcaaaaatcaaatatttggcagttataaaaggacataccatagattttaactaatctcttttatgtagagagtggcaaaaaatcttaatgctttaatgaaacctactttacaatcacgaatgttatttgtattctgtgaacatattgcaatgtacaagcagctgaacaatgaaataaatccaaaatccccaaacacttcccagtcagctcagcctcacaggtgtccattgggtccttggttctttgcttcctctccatccccagctttcagcacattgctgtgtggccgtcttgaaggaaagcccttcattctcttcaccttcgctcaggtttcctggctcactggctatggtgaataatttatccctctgattttaatgagtgtattttattgtgtttttaaaaagtagggacccaaactgatcttcatgctatctctttgtttaaaactatatttgaaaaaaatacttccattaattttttagatattgaatccagaagcactggtgatagcagcaataactaacatgtgtttttcatgaataggtggcaattattgcaaaaaaatgctttacatacgttattgcaattaatacagccaccaccttagtcgctgttattatacctaccttgccccagaacagtgaggcttgagcagctaaaaccacttgcttgaggtcttctaggcagggagtaccatgaaacccgtgtccactacagaatgcctggcgctgctctttttggctctgagtgtgcttacgattttttgaaaaacatttcccttgagacatccttttcttatagtatttgtagttttttcagcatatataaatatataaattgaattattataacataaacttataaattacattctctaatgaatggattcaaggctcctggcagagatactagtttttatgcttgtaatcaatcacacttaaatatcatgcaatccaaatgctaacaaaattactctgtccccatttggcatttagaaaacatcaaaaacatgctgatgatgccaaatagggtttttaagaatggggcgaaaggtgaaggtgtcaagtgcagcgaggattcctgcagctctttccttgtgtgggggtatgtcagcgtcagtgcaggctgcggtgtctggctctgtccttctgacatctgcggtggctgtggtccacctggagaggtggttatgtaggactcagggaaatacataattgtgagcattccatttattcaggttttagaaatgaaatctacaatcgcatgtgcctttctcatactctgtagtcgcagatctgatgagaaaagtgagagacagaacagagaaaaccctcactcctgggtcgggctttacttcttgactgtccaaaaaaggaaagatataagattttgattctttcttggaagctgcatcattactttgctttattgttcaagaaattgaataataggattatataataataatatgtaataataatcctattattcaatttcttgtcccttctgtttagtcttggggtgtgtatgcatgtgtgtacgtgtgtttgtgtttcacttttctccttgatgacatttaagactgcacccatttttatgttccaggtgttgtagatcttgtcaaaatggctgtctgttccttggttaccttctcctataatgacgcaagaagaatggttgaatttaaaaggcaatacatttagaaccaattaaagagaacatttttagcacagggtgtggcgcttacaagagttcataaaaaccgaagttgctgggaatgagttgccattcacctgcactagaaactatggacttgtgtcaacgatgggtcctttggggaggaaatcatctcatcacctgtgattcttttcttgttatcagagggagaaaatgttggcacagcttccctctagaaaaagatattgttaataattggttaattatgaagactgatgaagaaaagacattacagctgagatggttgggagggagagaatgtctaggctgtgaagcaaaaggaactaatgattagccagcagggtctgacaaccaggttacggtcagcagccccaggatatctgatcgtgtgggcacagcatggaaaggaatgcctctgaattggcctactaagctgaggcagaacaggcagacacactgggatttgagccggggatagggtgtggtcaggtggagagacagaactgaggccttcacatgtttgggggttctaggagggacagattctgtccagcctaccttttctcaatgcattaaactttggcaaagtaatcaggttgcagaagcaacattagagtatcctcctttagctgctgagttgggggtgaagtgggctgtaagccccggggcagttttcagaggacaggctttgagactgcctgaaagattcatcaccttaaggataaatttcctggaggcgaactagaagatcctgtgcattaacagaacagtcaatgcctgttatccaggaactgatgtgaacatctgacagcttctgtacctttcaatcttcaagcactgcatggtgaattttgtgatttaaggaaaccataaatgaattagatcacttttttccttccaaatgcgagattccaaatgacagcagaatttccgtccacttcctaaaagttaaaggtagaactgcttgagtgaggctaccagtgctgaactggcaagccaatcgtggccaaagctctcaaggtaaactgaaatgatcaatgtatttatagtaggataatcaaaatttatttattaaagaaaccaagatgagaccaagagcatccagtggccaatattgatgtgcctcacttgaaggcatttcaaaccatctcgccgctaaccaaggtacagcaagattgttcagctttgctgaaaatgacttgaccgtagatttgcttctggggcaaatggattgtaaattgctaaaatgacactggtttgaatggcctgaaaagaggaagggaactgctgcttccgtgttccctgagtgccttgtgtcattacctcatttactcactgcaacgccacacactttgtggcttcctgattttacagatgagaaaaccaagattctgaaggagtatgcagattccccaaaggcacacagctaatcagcggtggagcgaaattccaaacagctccaaagactgcctgtctccaaggggcatctcactgcatcttcgcaagtgcacaggcagcgtcagtccgggcactgaaactgacagctgctgcggtcttgattttgagacagtttgggtctcagccagtgctattcagcggcttgaagtccaaaatcacacccgtgcacatgtaggattgttgtctcacgtatcagtggacctgtcccctgcagggaagagttgataaatatggcactctgcttcacttttcttgtttttgttttagtttttgtttttgaaacagagtctttctctgtcaccctggctggagtgcaatggtgcgatctcggctcactgcaccctctgcctcctgggttcaggcgattctccggcctcagcctcctgagcaggtgggattacaggcgtgtgccaccatgcctagctaatttttgtattattagtacagatggggtttcaccatgttggccaggctggtatcgaaatcctgacctcaagtgatcctcccgccttggcctcccacagtgctgggattacaggcgtgtgccaccatgcctggctaatttttgtattattagtagagacggggtttcaccgtgttggccaggctggtatcgaaatcctgacctcaagtgatccgccagcctcagcctccgaaagtgctcggattataggcgtgagccaccgtgccccaccctctgcttcacttttctactctaagttcttttaaaagaaccatgacatggcagaagaagagactgatgaaaggtaggcaggaggggcactgccctgtctttggtcccaagccttttcctctcttatctgcagtcattcctgttaaggttatttccttgggaaaattccacacccacaattgtctgttcccaagcacaccctcacgtctgtgttctaacacccgcttcttacctactttctctcaataacaataaggtaagaagtaaattttctaactggcagacaggcgtatgaaaaggtgctaaacatcattgctcatcagagaaatgcaaatcaaaactgcaatgaggtatcatctcaccccagctaaaatggcttatatccaaaagacaagcagtaacaaatgctggcgaggatgtggagaaaagggaaccctcatacgctgttggtgggaaggtaaattagcacagccactatggagagtagtatggaggttccttaacaaactgaaaattgagctaccagggaaaggttttaacaagagtactgctaccagctgtaccagcctgcgatacatgctaaggactcaggtgctacgtgagagagatccagttaaaaccccagcttcaagatttaggggctgtggaagcttgtacgagtttcttggcaactctgattcacattttccggtgagacccccatctctactaaaaatacaaaaaattagctgggcgtcttggtgcacacctgtagtcccaactactcgggaggctgaggcaggagaattgcttgaacccaggaggcggaggttgcagtgagctgagatcatgtcactgcactccagcctgggtgacagagtgaaactccatctcaacaaaaaataaaagatgaataataacctccaagtgctgttgtggggattaaatatgagaatatgtttaaatgcttaatagctggcacttaaacataagtggaaaaagtgatcatgtgaccgctcggcaaatatcgctggtaccgttagttggtttgggctgctataccaagataccatagactaggtggctcaaacaacagacatttatttcctgaagtttcctgaagttctagaggctgaaagtcgaggatgagggtgcgggcagctttggtgtctggtgagggctctcttcttggtctccacaccgggcaggaggggagagagagtggaaagaggctctcacctgtctcttctcgcaaaagcactaatcccatggtgagggcctcaccctcatgactcaccacttcccaaggtcttaccacctgataccatcccactagggtgacgatttcagcatggaattgagggggcacacattcattctatattttagattgtgctacttgcaaataatttcactgctggaaaattctgaggggctggtcaataggaagtgcatgtcattgcaattcttatttgcagtccattttcccatgggttggaaagtggggaggaaggcatcctactggtctgggaagatccatttgctgatacaggtaagcagatagaggtggatttcccaaggtggaaatcctaaggtggatttgcttagtcttgggacctgttgctgtccacgcccctaccttgggctttgctgttcctccttccgccccacattggctgagagcccagaggtcagctatgcttcccattctgtgtggactctgccatatgcatccataaaggccactgccagccacactctgcatccctcatttatggtccctggaactgggaccctgtctgtgctaccccttgcttccttctcctgatgtttccaactggagagggagaggacattctcattccagagcaagccctgctgctccctcgttccatccatcatttcttcgcatgcaaagtaccttctaaatgccaccagaaaactttctgtcagtcagacagacatgcttttgaactgaaacatactttgattagggagcaaggtgagccgattctttctgttacgtatcagcaaatggatcttcccagaggggtagaagccttcctccccactttccaatccttgagaaaatgggccgcaattaaaaagacaagcacttcctgtttaccagcccctctgaattttccaatggtgaaattatttgcgagtatatctcactctttctcagaggttggcccagactcccaggataaaggaaagaccatttgggtcttcacatactgggaggaaacaaaactgaagacttttcaagcctctcaaacctactttacagtgattctctctttcatctttctttttttttctttgagatggagtcttgctctgtctcccaggctggagtgcaatgaatggcgcaatctcggctcactgcaacctccacctcccaggttcaagcgattctcctgcctcagcctcccaagtatctgggattacaggcactcaccaccatgcccgtctaatttttgtatttttattagagacgaggtttcaccatgttggccaggctgctcttgaactcctgatctcaggtaatccacccacctcagcctcccaaagagctgggattacaggcgtgagccacagtgcccaggccctccttcacacttttaattgggaccccccctgtgtcttgagggactctgagtggcattacagtggagtcactttgccattaatcctatcactgagagcaccaagcaggtgttcatgcccaggtaggctgagcatctgtatcaaggcttcctgagctttcctgtgccttccatcgtcacttattttactgcaaaataacaaatgctttttggggatacactaaagctaccacacatttaatattgactctggagtttcaagtaacttaaaatctactaatctcagtgaactttcgcccagagtataatgttttccattttctatttttcctttcatgtagttctactctagagatggatgtgagaaagataatacaggaaccatcctgtatctcagcaaactctactgaaatcagtaggtatcatgtatgtgcatgcacgtacacacacacacgtgcacaaattagccctgtaatgttattccatgtcagattgttgcctttggccaaactcagcgattgtgaatgacatctcctgctcggttcatgtaacgtacaggagacctgttcttagcatttaccattatccttccagtcttgactaaggttgggtgcacattcacagagactaccaactctcgattcagggtttgaaaagtctgaatggttgtgtattaaatggaaaagatcagaccaatattccctagccttggatgaaactgtttgtttgcaaaatgatgttttagacagaagtgagttttcagaacattaaaagattccagtgataatatttgcaaatcctttcatctgcatgaaaatttagcaactaaatctggccattaaagcataatctttatttgaccaaagcatgatataaaaatggaataaactataatttatctttgctgacagctaattacctggaagtctgattaaagggaaaactaaatttacttaattagtgttttggtgtttaatctgtatacatataaatatgcctatctcctctcctacatgaacatttctagaaataaattaccatttttattttgtccctttcagatgctgccaaactgagggcagcattagaagaatgggtattttagcaacaatggtagcaggtgtttgtagactgtgatcccattagaggagcagagtgaggtaacacaagaatgggatgcttaccacaaagtagttttcttttttccccaatggctcctcctttaactgtgaacaagaagagtgccaacttgtggagtgaaccagccctgccaatgaatcctggcttggtggtggaaaaatctgcatataattaagccccttgaggcaagtggactttgatagacaagaggtggctttgaaaacgttgaaatcatttgttttttagcagcagtatttggcagtgttgccttttgacggtttgaggaactatgctgtaagtacagccaaaggcagaggaggttttatggaactctcagctcccacccccacctcctgatgctgcaaagttctcccactagatgcaatttaaacaggagacatatgtaacacacctcaggtggtgtaatgaaatcatcctcttttctgagcttctgaaagtcaaatatacttatattaattttttaaagtgatctgaaagtcatacgattctattcttgaaatagagaggttttcgttacttaagtggcagacttactgacagttcagttataggcttacaaataattggactaaaatatgatttttataaagcattgtaggttttaatcaaaatccctacagaaatgaaagtcttaattaaatctgaaatcctacttcccagacctgaagtttccaatatcattttttattctcgcccaacatcctctgtgattaaaatagaacataagtggtgaaatcgctgattatttaaaggatagcatcatagaaacaaacccaaagcacgtagaagtcattttagactcatgaaaggtagaagatgaaagaggcttgcacagcatcttcatctcaggaagacttttgggtcaggttctgttcatttcattatcgtcactcttctcggttgcataattggaagttctctaaaataactacttctgacaaaatttctaaaagttgctgagtggaggcttaaaaaaggactaatatccttaatgatttgataaagattaaaatcacagtttcaggaagggttactttttgcctacttcacagacattcaccctcttctctggtagcctggacagtcattttctagaaccatcttccttctttattctgccatttggctgaatgacccttaaggtgacacaaagtaaagggactatgacaaggttaacaaatgtgcaacacaagttgcctgttctctgttgtttcgatgaagcattcagctcaatataaaaaactatatctcattaatacaccttccaactgggcagaggatgggagcacagaggggtccacagctgtaagtggaggcaaacatatgccatgaaacccaggccagtgaggaagggggtgacatgtggattttaatagttaatttttgttgttgttgttgtttgttgttgttgttttgttttgttttttgagacggagtctcgctctgtcacccaggctggagtgcagtggtgtgatcttggctcactgcaacctccacttcccaggttcaagtgatgcttctgcctcagcctcccaagtagctgggattacaggcgcacgccaccacacctggctaatttttgtatctttagtagagatggggtttcaccatgtcggccaggcttgtctcgaactcctgacctcaggtgatccacctgccttggcctcccaaaatgctgggattacaggcatgagccaacacactcggccaatttcttttttgatgtccaggtacagagaagttgacattttcatttaaacacatacttgacccaaggacacaattcctttaatacggctgggtatgctaagctatggatcatcagtgccacagtaaaaatggacttgtgtttataggttgtctcctggagattgttgtgaattatatgcattttaggaaataataaacttgtaatatgttcgcctgtgtgacttaacgccgtgtcagctagagtaagtgtgcagcacatccaaaccggaccttctatggctttaatacttctgaagacctctgtaaagattcttccttctcagtacccaagtgctgaaaaaaaacatgtattattataggtcagaattagcattttagtcagttattctagaagtagagtaaaaaacaaattttcagactcacttatgtatttttcacatgggtaatcctttgagtcaggaaactggctagagttacattccataaataaaatgttttgatgatgatgccaacttgggcatggccttgtctcttaacttaggaggaggacaggcagacctggggggtgatgattaagtaaaatatcagtcagacagatgaaccgtaggacaaaaccaccaccaagggctgtggggatggagatgagaccctggtcacctcccctggagaatgtggagaagacttcaccctatggttgatggacatgtggtctggggctggaaggttcagtgggattttaggaaggggagaaggaagcaggaacaggggaaacagtttgatctgagacactggtgtaaggttgggataattttcagtgacatggggaggaacacggccttgaagggtgggagagtggtcttccattcatgacttactgagcctgtcatatgtgtgatgcagtggaatccacagaggattctgtcctggatcacacgcaaacccagccttcatggagcttgtgtgtggtatggcgtgctaagtcgtagacccattacttaaaatgactgtgttgttaaatgtcaaccgagtatcatggagacattcatgatgggggactactgtggtctagatcagcggtgtccactaaagacatttgaagacgggctgggggcctgtggtctgacccaggccaggaagatgtgtagttcagagtgagttgggtatcactgctctgccttgaacaggtgcaccctggtgttatgggactatcaggttcaactgcccgttgcatggtaacagaccaccagtacaccaaaacagcaggatgtggagcagacaatgtgtttaataatcatagggcagctgaacaaggagacaggaggaaacctcaaatccgcctctctgaggagctttacatgggtgtttttaagggaattttggttagggggcttaggagctggagatcactgactggacagtgtgtgggaaatgaaatcataaggatgtagaaattgcactcctgcgctgaggctgttcctcggagggcattttcagatgggctggagtcagtgggcccattggactgtaggttctggaaaatatctccaaatggaaaatttgaggtttcttaacatttaaggtgttacctagagaagttaggagcatgtgacgggggcacgtgacttctaagcagcaagcagctatcagaaagtgggccaaaggacaagctggttaatgcgtcactgtgcttctacttaaagcttatgcttttgttaaaaatttagcaatttggttttattaattttatgaggacggtttccctggtgagcatttggctccacagagagggatccaacagctaagagtctgcagtagaggcgggatcccacagcttcactgatcaccccattttcctgtggccccaccaccatctcttctcttctcccaggaccctagctcgggtggaaacagtggggaggccttggtctccagctcagaacccaggagccaaaaatagcagctgagtgtaaattttcattaagacaggggattagagatcaaaaggggtggcctcccactctccagaccccaactcctccctgagtcagcacccccacctgcacctgcacctggagggaccctgcctgcccacactcggtggtggccacagcctgcatctagcagggtgtaccctgtgccaggtggcaggagagcctggaatgtgctgtcagttctcagctgatctacaagggtaaccacagtcaaagccattttaaggaggggaaagttaagtaaggaagaggccaattaatgtgcccatgaggatgttaacaagcagccttggaattggagccaagacaggactccagagcctgcatggggggcctctgggtgtatcatctttgctccagctgagcaccggcttgtctcaagaacaggctactgcatggcacctctgctcccctggggtcctggaaaggttccctggtctggggcatctgctcccagccctctggaaggtgggagtgaggatgatgacatcccagcagggcactggccgaccagcctgctcctatagcaatgccttcctgtcctcctgcccactgcccctttgggcactgctggtggccagcactggcggccagtgctggcctcttctccctgctgcagagctgcttccataggcggacctggtcagagctcaagtggaggggaagcaaaccttttggagtgtcttgggttacctccttaaacattaaagacaaggccgggcacggtggctcacgcctgtaatcccagcactttgggaggccgaggtgggcagatcatgaggtcaggagatcgagaccatcctggctaacacagtgagacatcatctctactaaaaatacaaaaaattagccaggagtggtggtgggcgcctgtggtcccagctactcaggaggctgaggcaggagaatggccagaacccgggaggcggagcttgcagtgagccgagatcatgccactgcactccagcctgggcaacagagtgagactctgtctcaaaaaaaataaaaattaaaataaaaattaaagacaaattaaaaatttgtccttaaaaatgcagggacatggatgaagctggaagccatcattctcagcaaactaaaacaggaacagaaaaccaaagactacatgttctcactcataagtgaaagttgaacagtgagaacacatggacacagggaggggaacatcatacactggggcctattggggggtgtggggtaaggggagggagaacattaggacaagtacctcatgcatgtggggcttaaaacctagatgatgggttgacaggtgcagcaaaccaccgtggcatgtgtatacctatgtaacaaacctgcacgttcttcacatggatcccagaacttcagtaaatttttttttagatgcagatgtttatgcactgacttaaatatttaataaggcatgctttaatttgtttgtttttacttattgttttaaaagctagagtcctgaccaatttgcttctgcctccacacattttgtttttagagatataaactacaagtatatctcagcaatatgaggccaggaaagagatgctccgagcatgctctgtagccgtggcccctgggccagcagcatcagtgctacctgtaggcttcagacctgcagaatcctagggcccagcccagatgcactgaatcagacctgtattttaacaggtcccctgggtgacctgtaaccacattccactttgtgaagttctgtttaaagaagcaggcctgggatttgcttactattcagtgaaactttcaataaagcttcttttctcttcctccgtgaacggcagttattttctcgtagcaagagtctggactacagttgttctgaatcttttgagtagatattgaaggggagatacatgagcatgcaagcagacgtgcccagtatagcgagaaccagaataatgaacccctgcaaagtgggagggcatttggaaagagtgcacgctgagttcatccccagcataaaggaaccagcccgttattctaatctgatgagggaattcttcctgacaattgagtgatggaaggaggcattttaaatctttccatgtgtgtctcttctggcaagtggacagggcttgtgatgaatcctaggtctgataccagggtctttaatgtaaaagacaaaaacatactagacatctagcctattaaacttgaactccagccaaataagagctgatttcctgctgcaaatcaacaaaagacctcctgcacatggaagacgactctgacactaacactgatttagggccaggaagcctgcagtttaaattaagctggaggatactagctttatatgaaaatggcaggcaagtgtctgtggctcacagaacaagtatgatatacttttgttgcaagacctttgcatagaaaatcatcttcttttagaaaataaattccgttgccaagttttgtttcccattctactctgccccttaatgtccaaggagaattctccctgaagtccttgaggatggggcttattcagcacatcatagatttatgaagcctttgccatgtgtcaagcactgtgctaagcccaggggattaagagcaacaggcaagccacagtctccctctgtgcaccagccctggctccgtgaaatcaggaaagcaggaggaaagaactcaaagtgcacgcctggggaagtatcactgccacctaaacccttcttctcagctatcttccctatccaaccactagacacactggtgtttctagtcgtctcaacttgctctctttctatgagttccacaattctcagtctagtaataatagccaacatttcttgaatattgtcatgtgtcatgtgataagcccagtgtggtgttttatatgcattttaccatttaatacaatggccgtataggaggcactatctttaccctattttattgatgagatattagggactgggacagacactcctcatcctgagcctaagccactgcaacagcttgtaaactttcccttccaattccaagctactcctttccagtatatcctgcaaatggcttccctattaatattcctaaattatgatttcgctgggtgtcttttctcttcccaaagataaacactattttgacaccttcaccatccattcggtttggcttgctttggaaccctgtataaatagaatcatgcaatacatattcgtttgcatctagcttaatttgcctaagattatgtctgaaagtcgcctcacatgtagtactggttcactcttcgcatttctgtaaagtgttttgttttaggaatgtagcaccatttattccttctgctgttggtggatgttcatattgcttccagacttgatcattatgcacaatgctgcgggcactcttgtatgttcagtgcataagtgcatgcgtttatattgatggttgtgagctatgaacatgttcagctttggttgattctgccagagatttccagagtagttgcaccaatttatactcccatcagcagtgaaccagaatgtcattttctttacattctctcctcacctgcccttgggaggggtgaggctgttttggtggtggtggtgtttttaccattctggtaggatcccattgtcattttgatttccatttcttaggtgacttgagcacctttttagatgctattggccatttgggtagcctccttagtcaagtacctattcaagttttttgctcatttttaaattgtattttatttgctcattttgtattatgttgttattgtatggctcccttatacttgaactacaaaagttatttatatattctaggtatgagaccttcatcagatacattattgcaaatatcctttctctgtagttggccttttcatataatatttttcacaatggtgtcttttgatgaacagaattttacaattttgatgaagtctaatttgttaatctttgcttttttagagttttaatgaaatatctagtgttattcaagatcatgaaaatgtttctgttatttgctagaagctttattattttaccttcaacatttagatctatgatgatccagaatatctttttgagtatggtgtgaggtaggggtcatgattcatttatttgtatatgaatattgagttcttacagccccatacagtgaagacaccatgctttcccccacattactgctgtgaaacatttgtgagaaatcaggtgacaggtggatctagttttggactttctatctgttcccctggtttgtttacccctggagagaaatcacaatatgtaagttactatatcttgttaactggtagtttaagtggtttagatatcatctttaagattatctttattattctttgccctttacgttttcattaaaattttagaatcggcttgtcaaattacacacacatactcactcacatagtggttgagattgcattctatgaaagattaaattagtaagaatttacatatttacattataaaattttccaatccatgaatgtgatgtactcctccatttgtttagatcatctttaatttctcttaacctcattttaatgttttctatgtaaggtcttgcttatttttatgaggttcattcctaagtgtttgagggttggtgaggctaatataaatgttttattattttatttccattttctgttttttctatttaatttctattctgttcattttctgtgtgtttatatgagtgaaatggaaatacaattaacactaattttatattgactttgcattttcttagtccttacttaaaacttggcattttattttatacagttttgtaattttatttggatgtttatttttcctgttctcacagtacttagcccaatgttgaccaaataaatacttaagtacttgtggatttgttgattaatgatttatttaaataacttttgtcctagctgggttaccttaaaagttctaacttggtctggcacagtggcccttgcctgtaatcccagcactttgggaggctgaggtgggaggatggcttgaggccaggagtttgaggttgtagtgagctgtgattgtaccactgcactccagcctggacaacatagcaagaccttatcccccaacccccccaccaaaaaaaaaattctaacttattatatcaatcttttcaatagtcagacaattctatctaagaagttaaatgtaactgaattccatgggcttctcaatcatttcaaaaattacaacttttaaaacaaaataataattccggaagtagatatacacattttcctgcaaatgtttctgtactatgtcacatcttgctgaaggtcattttagttaaattaatgtaaaatgcagactgcatgaaataaagaataaaaagaacaaaagaatagcaaatagaaagaattaaaaaaacatgggaaggcaattagcgaattttgttgaaatttgacactacttaattagcagctcaaatttcctgaagcttgaggctttaccatctagacaatattacattgaattttgggggtttaaaaatataattaaaagtttattggacaaaagttttacccacacctagcacatcatagacaacactattgataaaatgaaattaagctactgtatttgattatcctcataatatattttaaatgaaccatgaacaatgaatagctgacctatagtaaaagcaagaggttaaagtaaaaagaaatgtatctaaaatgaaaaaacatacacagtagttttctttgattttaaaccaaacatggatatgcctgtttcattaatgcattatctttagaaagtaatgtggggcttttttttttttttttgcaattgaaaataagattcatttaatcagctatcgtagttcatctgttaaattacagcactttgctgtccattttgtaaaataatcttcaaactaatgaagtaaggtcaattgcatgcaattttattctagccaaattgctgttaattgcatcaacggctttggtaaggtcaataaatgttgcctttttacatcctctcctgaaaatggcagaaaataaacaccttttctctgtaatgtattcaggctcgaggcaactcatagcaggtggactattcgattttcattacctgatttgaaaatgttccatttctaaagaattgtgggaggtattggagtcaccaaagcacttttagcaaagatatcttttagctgggcctggtggctcatgcctgtaatccaacactttgggaggctgaggtgggtggatcacctgaggtcaggagtttgagaccagcctggccaacatggtgaaaccccatatctactaaaaatacaaaaattagctgggcccgatggcacatgcctgtaatcccaactactcgggaggctgaggcaggagaatcacctgaacccgggaggcagaggttgcagtgagctgagattgcaccattgtactccagcctgggtgacaagacaatgtgaaacttcgtctcaaaaaaaaaaaaaagaaaagaaaagaaatctttctcggaagtgctcccttgttactcttgaattatgtcagtggtgtccctcaaatagagacaaacttatactgaacaactcagagtagattgtggaccttgacttgttaagattttaatttttatgataatcagtctagagcagatcatctgttctcctttaacctgtcttacaacaaacagtaaatgtttgtatgtcagctcaaccatagttatactgtgaggtataccagttggctcacctgctcagccgtgcagcctaggtcagtgtaaggaggggatatattacctggacccatggagggttaggacctcgctgtggccttattcctgctgcagacctgacccagtctttaggacttgatcacatctttacaagctttatgctttaagatatgcttttctaaccatctcaatttgtaaactgtgaacactctgtggtttctgaaatggcggagatgtgtctgaaaggtgtcatgtgcgccgtattacaaagaaaccctaaaaacagcaacaagtgagagatacaggtggaagtaagagcagtggctggaggcagagagagactgtggcaagcggatggcactcgacgtgtgggggcagttccctaggacctctgggagagttgcacttatcctattttccttgccttcacataaggtcacaatcactattagagtctgtttgatatactcattactaatattgattttacagttcaagaaacaatatttcttcttttgttttgagatgaagtctagctctgtcacccaggctggaatgcaatgacgtgatctcagctcactgcaacctctgcctcccaggttcaagcaattctcctgcctcagcctcccaagtggctgggattacaggcagccaccaccatgcccggctaatttttgggtttttagtagagatgaggtttccctatgctgaccaggctggtctcgaactcctgacctcaggtgatccacctgcctcggcctcccaaagtgctgggattacaggcgtgagacactgcgcctggccaagaaacaatattcttcttttaaaactgaatgagcagaaatactgttagtagccagctgaattcaggaaatgtgatgcatgtgctggtgcacatacccaagaagactgaagacagcatagaaggacagaacaaaaggccagtgccaagggtggcagagggagtccttggtgcactctgggacaagccccctgcgtgctgggtgtttcgggtggtctgtctccatgtgcaatatcagtcatgtgaagccttaacaaggcattcatttagttagtatttcagatttgccaaccctgttggtgttgggataagggttagagatacagagaagcacccctgccccggaggagatcactgcctggtgagaaaaccaggatgggcttctactcaccccttcaagtccttgatgaaaggttccttctgcaggagcccccagcccctgccttctgctgtgtcctgctcctcctcacctatgctcctggcccctcttcccctgccttattctttatggcaccattgcctttccagcttagtttcagtggcttgctcattttcatttctcctcactatcacacaagctcccagagagcaggaggtcttgtcattttttgttcatttgtttccaccaagatacttagaacaatgtctggcatggtgagccctcaaaagtatttatggagggaatgaatgaactcgtgaataaatgaatgtatgaagtactaatagatgggtgagcatggaactctatgtgatcaagtgtaaaaggcactttcccaaacacaggacttaatgagaggcagtcagatagtcaaacactacagcacttgagttagagaaacgttttgactaatcaaggaagcctttctgggaagtataaatgtctgcattagaactagaaagtctagaacgccgtaggaaggtacagaggacaagaacgatctccttgggcaggcagaaatgatcgagctgcgagctgccggaggaccgcatgcaggggaaattttgcttttctgagtgctgcttggctttgagatgtaagatttagacgttagacactttctagctcattttactatgccagtagtgatcctccctttcttatttctttaagaattgaagctggcatgaatctgttttcaagctgccatttagaagttggaatagtgtgttatattaactttatttattcttaaaatatcatcttggtgcccaggatgacactgcctgaggagctatcaaagagccaatccctgtgggatttgtgagaaaattcagccatctctagacctccaattccaaacctctttcatctcccaagactctatactttgatctaacctcttgagtgacttccttcaatttcttcctttcacagcaacaatttcagtcccagggcatacacttatacttataaactatttctggggccagcttgacctcaaacccgtacaagatgatcgttccagacagagaaattctcaggacatgaaaactttcttagaatgtgctgaaatagggttgtgaatgcgtgtgttgctacctctgaaaacttgatttagtgctgtccagcaaaagtcttgacatcctatgttagttggctcagctctatacaaagaatctgaaagcacggtagaagatggttggcttgtgttaggttagaaaggcgtaacaatgagttgttttctaagtgaccagcatgtgtgatttatgactgtattccagaaaaattcaattatatgagataaataagtacagagttagtatggggcttcagaataacaggaagcagcataaatattgccctcgcccaccagaattcatcactgatggcctgctctggccctgccttctgctgtgcatggaatttttattgagcttgatgagattctgtgtaataagatgctggattccgggggctaatggcctacgagaagatttgagtgttgagattctgtataatcagatgctgaactccatgggccagtggcctattgagaagatccgtataataagatgctggattctgtgggccagtggcctatgagaagatttcagcattgagattctgtatagtaaggtgctggattctgtgggccagtgggctatgagaagatttgagcgttgagattctgtataataagatgctggattccgtaggccagtggcctatgagaagatctgagtgtgcctactggatagttacctgctggaatgcaagttgtcactgcaagattgatttctagtgacaataacaagcagaagctgactaacagcacactgcccaccatctgctcaagatacccaataaagtgtatttgttcctcattttctcggaaaagtctccacctgaaggtcacagtgagatagaccaccacagtgaaaggacatttgaggtttcttcctgcctgcactggtgatgacatcaggaaacttgtgaaaccacggtcttttgtttacattagaaaatgcatgtgagatgacaggtcaacatcagcaaggcataacttaacagagataaaggtaatgctttctgttggttagaaaaagcaaaagttttgaaaaacacctgagcaaagaaatcttgagaataattgctagccaaaaaaaaaaaaaaaaaaaaagaattggggtcatagggaccaacattgagacactgttgttgaagcagcaatgaataggtattttgtccaaataaaaggacgtaatttaatcattgttaatgtattgcccatcattggtaagccctcgggcatacacttacacttataaacttatttaatccacacatagcattatgaaggaggcattatcatccctgccttacagatggagaattggagtagaagaagtagtaggtaacttgcccaaagtcatagagggtatcgacttatcgactgcactgctgagtttagggtctgcagtttgtctgccatgatggctcacatctggagtgtcaggttcagccctagaagccacgttgtctggtggtgaacactgaccatcttgcagtcactgggtccacaagaggggaaccactgtgagaaggtgtcctgtgaccaacattgttgaggagtatctaaagggtgaattcagggaggttgtgctacagccttaaaaacacataaagtaactcagcgtcatcctttcttgttcacactggaagaactgaagtcaatagctggtcctagggagatgaataccaatatgagagatgcaggctgcacagacctggaaacagcttctgtggcttcgctcaggaaagaagccagacagccttctctcagggctcctgcaagtgggattcctgccctgcgggttcccaggtgaacacaaaagtcagttccaactctaaaattatttgtcattcggtacaacaaagataccactgcctccctagcaatagagttttttgtttgttttttgctttttgagacggagtttcaccctgttgcccagactggaatgcagtggcaccatcttggctcaccacaacgtctgcttcctgggttcaagcgattctcctgcctcagcatcctgagtagctgggattacaggtgtgctttatgatgccatgctattttttttttttttttgcatttttagtagagatggggttttgccatgttggccaggctggtcttgaactcctgacctcaagtgatccacccacctcagcctcccaaagtgctgagattataggtatgagccaccatgcctggccgcaatagagttttaaatccttctagaaggtactccctgagccaaccttgcactctctttgcaccccatggttattctgatgaggcagccattcaaggccacctgggctggaggcctggctgctccgagtgcagccctgctccactacatcagcatcaactggagcttgtttggagtggagactcttcgtccctgcaccaaccatcactgcagttttgcagggtctcagatggttcccgtgcacatgaaggttggattcccacatgaaaggctgtcatcataacccacctggaggagctttcagaagactatggtctaggtccttcctcctcccctccacccattgttcttggtgagccctaggcattgccagtgagggtttccaaagctctcccagtggctacagtggcagccagcattgagatgccctggtataaggccacagaagccagccacagtgaccagccctcctgagggttggccatgaactgatctctagggctctgttgagccttttgaacattgtttagagtaagaggaaatgtagttgttataagaaatgctcaatgttccagaagtgctatgagttactagaacaggaattttcaatggcagttttattccagtttgtccccagtgcttcaagagagggttgggtagggctttatgtgtttggggaagttgctgaagaaagcagctgaataactgaatccttttacttataaaaaggttcaaagttgtccagctgaaatgctgaggttgggagccttcaaattgaggacctcagggttctccaaacagaaggcttgcaagttccaggctgaggctaggggagctgtctgtgtctgtggcccccatgggtgattggtcccctctgtctgagcacgtgcgcggaaaaccatgctccgtgggttgacagctggtggtttgcttatttgcttgttttgaaaatgtctattttttaagactctattgtagctgaatttaatataaatgctttcatttgaacatttggccatctttctttagctaacatgtgctcttatttttatttagcctatttttaaccattgagttactacaaaacattatctcaggtttattttcatctgttacatgttttaaactgtagccatctgtgtctgaaacatttttatctgctacaagttaatattttaaaatgttattaattgggtaattatttagctgtcttcaaaaaacaaaaacaaaacagcaatcctgcttttccagctagtgagcagaaagtcagggcggtggggagtgtgttgtctgtccagccctttgcttgggacgggagtggtctcttgtgcttccgtgccctggtcttacctcaaagttactttcttaccttgaagacccaccattaaatataaactaatcagcctatataaacacaaatataaccagtaaaaacaaacaaatcaaactcatcataagtataagcttttagaaaagactgttgtcccaactttgacaaaaaagtggcatagtacatcatttgaaattcaccatactcacatggatgatgtcaccatccccgccctcagactcattgtccatctgttaggaagaggtgcacccaccacaggcagagcacagctacaggcccacacacacttatgccgcactggagaaaccgacctgccagcccagctcatctccttgtttcttgaattacccagttcatgtatgagaacaagaggaatgtgatctgaaactccccagttaacaagctgtaaaactgcttgacgcctgccaggctgtgcgaacaaaccaaggggcaggaggtgagggcaggggcggtggggtggggggttgcattctggaagagtcccagggtttcctctgcatcccttcggtgagcttagtcgcagtaccttagtcacagccaggtagctgccgttctcccattcccaaaggacaaatgtactaggatttgttaaaaagggaaaaatcctctgcatctagaaccaaatacctctctcatctcttccctgatgggagtaatcattctgcacctcgagattgacttgatgtcttaacttttgcattggatgatgttacctatgttgggagttacatcggaaccggcacagtagttgtcaacttcagctacatgggaaaattcatggaagaagcttgaaaaaatgtaggcacccagctgacattcattattgaatgaagtcataggataagcttctttctattagatttttgccccagcactcagatgacctccacaatctacagacaacccagagaagtgggagggttctatcagtgagttacaccgggcttataccaccaaataactggctcaactggactcagaaaatgggctgttcatttgacttggtgtcaggctgaaaggaagcagcttcatccaccattatgtcaagacatagacgagttcagaaattcattgcaccgtaggttattgttgagccacatggaattaaagggcttgcccaaagcagatacttctctggattttgccaagctaggcagtcacacttcccccaaaaagaaaagtagaaattagacaaaaataaactttatagcactagaaccaattttaatgaaccacaatcatgatacggatttagtagagaccataaaatccacaggacaaggtgcgatctccacttgcctttggtcaaagctgagaaacaaagaaccggaagagctcactccattgtgtcctgttttctatggagagatgagccccccttcttctcttcctgtgaaccagcttgaatcggaggggaacgtgtaactatgaggttcagatcacactggaacacagcgtggtccatttatgctcagagtccgccaggtggcatggacttcagacagcacagataccctaattaccatgcctggtcttgcggttcacattcaccgtccttcttaaaagtggggaagggggccaggcgcggtggctcatgcctgtaatcccagtactttgggaggccgaggcgggcggatcacaaggtcaggagatcgagaccatcctgactaacacgccacggtgaaaccccgtctctactaaaaataccaaaaattagccacacgtggtggcggacgcctgtagtcccagctactcgggaggctgaagcaggagaatggcgtgaacctgggaggcggagcttgcagtgagccgagatcgcgccactgcgttccagcctgggcgacagagcgagactccgtctcaaaaaaaaaaaaaaaaaaaaaagtggggaaggggaaagggagccttgtctctatcttccggggtaagcctgcgctgctgggctcctgacaggttccatagactcctcttgcagcacctggggtgctatcttgtcacagcttataacctgctccagagcctggctctgagcaaaattgctgaggctgaaaaaagacagtaatgcaactcaggctgctagggtgttctcactgacaggactgcagattctgtttggctgaccacaagttacaaagatgaagacaaagtgcgagcaattcaagggccagcttgactagctggtaaaacgagtggcaaatgtactaggatttattaaaaagcggggaaaaagattccctgcatctacaaccaaatacccctcccatctcttccctgaagagaaatgattctgtaccttgaggttgaccggatgccttaacttttgcactggatgatgttacatatgttgggagttacttcagaatcggcacagtggttctcagcttccgctgcacgggaacgttcatggaaagaaatttaaaaaatgcaggtgcctagcttgcaactgcagagattctgacttcactggtccgcggcaggattcctgctcttagatttaggtaatctgagagttccccccaagtgattgcagtgtacaaccatggtaggcaccgctgcttaggttgaatgacatcagcagaatgttttaaatcaacaggtttcatgagtttgagatggaagaattgggtgaggtagaacccattaaaatagttaaatgggataaaaaaaatcagaaagttgaaacaatgaaaggcagatgtgactttgtaatcatcaggacatttagatttgcccaagtcccaatacaattccctccctgtgaagccttagaaattcctcagaactgtctttagtaatagaggcatgcaatatgattggcagatgaatttacagggaggagtttgagcacgcatggaaaacgttctgattttgttgtctttgagatgctcttcgatgtcacagaaggaaatgtatgattagtgtcggtgttcttgtcaagagatggctctcttcctttcttaggggaggaggcaacgacgagctttccatgtcccattggagttgttgagagacagggactgacaagatcaataattgtttccaaataatggggcgcattagcagcttcccagggtcatgctaaggtgacaggtgggggcagatgtggacagagacccggaaggatcctaactaaaagggaactcattatgtgtgatggtccccttgccagccataggagacatttctactagccttggttaacctggagccacagtgtgatggcaacaggcgctaggccatgttttgagttagtgtaatttcaaagtgtacagtttaccaaatttgaacttttttttaaattttattttttctagtctggcttttgcaagtgactctgacaaaatatttctgcattcaaatatctggcatttctataacaatttgagaagcttggccttataagaaaatctccaccaacacctggtgtatgttcatgtgctttataaatattaatttcattgaattgaaaagccaaaagtctgtttttatgatataggtttgttttcttgacttttctccaaaattattactagagtctcattttttaaaaagtctgacaggaacatacccaacatatatttttaagtaatacagcagaagaggaaacaattagaaatcagagtgtgtagcatgagtaagtgtaaatataatttcctgaaatcttcatttcaattgtgtgtgtatgcaattagattgtaaaatttattattgattgattgattgattgatttttgagacggagtctcgcactgttgtccaggcgacagtgggcgcgatctcggctcactgcaacctccgcctcccgggttcaagcgattctcctgcctcagcctcctgagtagctgtgattacaggcacctgccaccacgcccaactgattttttgtatttttagtagagacagggttttaccatgttggccaggctggtctcgaactcctgaccttgtgattcacctgcctcggcttcccaaagtgctgggaaggcatgagccaccacacccagccgtgaaatttactttatactgtggaatgtaagtgaaattctgaaagctattggataatggcgttgtttagaataataaccttatagcgtaaaccacaaacatgaagtcagccgactactgcgatgtatgccaagcacaggaatctggagaagtacgagcctcctggctccccactggactttttattggggtgctagaccagtggttctcaaagtgtgctccccggggcagcagcatcagcctcacttgggaaattcctagaaatgcagattctcaggcatcctatcccaagcccaccgaatcattatctctgggggtgaggctcagcaatctatgttttaacccttttcctgtttgctttgagaatgttctctggcagcgcttgcggctgcagtgtttactccggataattttgccacgaaacatctcacttttgttactgtttttgcattgttctagcatatcgtctttggaaacaaaagacatcattctatttacagcattctggttttagtagttgtatttccatttacaaaacatagtaattctcgatcgctgaaaatgtcaaatcctagaaaacgtagcattcctacgcatgatgttaacatcgttcgcaacagttgttgaccaaagattcattagatgaattaaattttcccaaagtagatgattctgatgttagtaacaagaacagtttttatatttcactttcaaattgaaaatcagatttgcttcagcttcaaagagcatgttaatataaaattaaatgagcattgacggcaagctgcatttttttcctaaacaggaaaagggttgagcctcgcaggtggttctcttctgatatgtggcctctgagagaatacctggccagccaggtatgaaggtggaccatgacctccctgtctcagctccaggcctgcgcaatatccatcaatcccataggcatttaggcctagaagctaatcatgatgggtgtttcttttgtttgttcattcgttcgttcgtttgtttttgagatggagtctcactctgtcacccagacgggagtgcaatggcccgatctctgcccactgaaacctccaactctgggttcaagtgattctcctgcctcagcctcccaaatagctgggattaaagacacgcaccaccacgcccagctagtttttgtatttttagtagagatgaggtttcaccatactgatcaggctggcagtgttttcttctttacttctgttgctgaagtttgtaactaactttgtgtcaactgtttatttatttatttttgagacagagttttgctattgtcacccaggctggagtgaaatggcatgatcttggctcactgcaaccttccgcctcctgggttcaagcgattctccagcctcagcctcctgagtagctgggattacaggcacccaccaccacgcccggctaatttttgtattagtagaggtggggtttctccatgttggccaggctggtctcaaactcctgacctctggggatccacctgccttggcctcccaaagtgctgggattacaggcgtgagccaccacacccagcctcaactgttacttgatcaacccttaacagaatgtggaagttagtgaattgctaacgctgcccttggcctgctatttcccagctggcctctctgtgcccagcccagctctgagctgccacatgtcccctgcctttcaaagaatccaccttctggcctgacttttctagctaaattttacaaaccataattcctagctttcctattttctcagaaaaatgtccaccaggtgtttattcaggtgtctcattgttataatccaataaataaacacatcatattcatgggatagcagatatatgcatttatttatttatttatttatttatttatttatttagatagagtctcactctgtcacccaggctggagtgcaatagcacaatcttggctcactgcaacctccgcctcttgggttcaagccattctcctgcctcatcctccctagtagctgggattacaggaacccaccatcatgcccagctaatttttgtattttttgtagagacagggtttcgccatgttggccaggctggtcttgaacccctgacctcaggtgatctgcctgcctcggcctcccaaattgctaggattataggcatgagccaccacgctgggctggatatatgcatttaatagggactctttgatgcctgagggctcatgttatcaattgtgaatacaagacaggcctatgggaggggtgtttattttttgggggggaggggggatgggcagctggatgggagttgagagtggtctcatgttcatcaaatcagcccaagtagatgattgatttctctgcctcagtcagattttgtgacaaggtaaagcagtagattcttgagtagttgataaatgatattacaatcttttctaaatttaaactcttcgttgatctttgtcctgtttgtataacctttatcttttttgaaaaatgttagttcagcaactgtttagtttaattagctgattcattaaacttgggtggtggctcaccaataaaaaagcatttgaatgtttgaatgtcactcagagctcttcaatttctttgcagaaatactcaacctagattcttttaaattctctacctcagaacctgatagaatacttgcatatttttactgatgatgtttcacctatacttaatgtaataagtaaacacactacacgagaagtcattctgtaggaaagtgagtgcggatttctaattacttaggcacagctagtttcctagcctgacaggtgtggaaacacctttcacactcgaagcatgcagaggcttgcatgagctcacctgagcattctgaggagcctccctatgcagttttggaaccctctgtttgattcaaaggtctgctcctgataccagggaggttttagctttctgccaaaagaaatgctctttcatcttcaaatcaaatgttgaagtgggccgggcatggtggttcacacctgttatcccagcactttgggaggctgaggtgggcggatcgcttgaggttaggagtttaagaccagcctggccaacatggcaaaaccctgtgtctactaaaaagtacaaaaattagccaggcatggtggcaggcacctataatcccagctactcgggaggctgaggcagaagaatcacttgaacctgggaggcagaggttgcagtgagccgagattgtgccactgcactccagcctgggagacagagtgaaactctgtctcaaaaaaaaaaaaaaaaaaaaaaaaaagaaagaaagaaagaaagacagaaaaaacaaacaaaaaaatgttgcagtgaaaaaatatcacctcctcctactctcaggatggtacttctgcccattctcctgagtaggctcaagcttctgaaaggagagaaagtgggagtggttgatatttcgtgactctcactggcgaaggcccacttgcagactggccctgcatcccgctgtcctgaatgcacacgtctgtgtgccgtgggatggcctctagagcgattcctccctgaatccctgcaacagacacctctgagtccaggcacagcaggatttcaggaaccagggaggagctggccaggtgtacacccgggcagatacctgtgacccgtgatttcaggggtgacagaaaatgcctcttttccaaacaccaagcaaaggaaccaaaaccaaatctacacaaacatgacctttccctgtaactctcctgattgctttcatcctgtgctttgaaacagggaaaatgcgtagacataccgggaagccagaggggccgtcgtcctggttttatgatgcgggcaggaggaagttatcaagggccgtccctgaaaacaggctttatttggacagtgtgagggatgtaaagaggagaaaggcagaccccagagagaacaggtgccctagcagagatgagaccaccccccggggagtggggagagcctcaatcagagtcccttactggaggtttgctctggggcagccccagtggaggttgctgcctgctttcatgttgtcggatcacattctccaggcagaaatggtttggaggatcctgggatttgaaggctggtgctcgctaatcatggctatgcatgaagcgtaacacagggcggtttgagtcatcttcctcggggagttttgagaggaacctaggatgccttattaggaatgaggttattgcagagcatggattttctgaaagacaaggcaagcacatggccatctggtcagcactcaccgctccctcccctgccccaccatgagtcgcccccaacacgcagtgcctgtgctgaacacactgtgcctggccgtgcgtgggcagtcacttcctagcccagctcccagactggggtcgccctggatgacagcatcacccttgtgccttgttcatttacctattcagatatgaagtcaagatactgtgggtgtccagagatgcttttttaaaaattgcttcctggggaataaaaaggaatggccattaacacattagttgacatgctcaaaatttaatttgcaaacagaagccaaaagagacagctaaaacttttcattggaagcaattaaaataggaaagcaacgggactgaacagttgatagtttgccagtgcaggttctgctctgtgaggcacgtccaggaccccctgcatcagtgtaagtcggcatacaggggttagagtgcaccatcctgggaatgcatgacacataggtgtgcttggttacagaccagcttccccaccacccaggctgaggcctttgcagacagaaatcaaacctacctggattagcacagccctggggactgaccctggaaatggagttcgcgtctcttcccctcttggcctgtctttatcactcacagctcagttagtgcctctcggcatctccttcctgctgtcttgccctgcaccatccgcttcctctctcgttttctttcttcctcacattctttcatttaaaaaaaattccaagtatgagcaaaaaataattttaatgggatgaatacactcaattatggtcttagttgtgtgcttaaagggagtaaacttagaatgtgaagagccagaactagaaggttcacagtctgtgtagtctcttcctaattaattcatttttctgtaagggccagccttcaagaaaatgtagaaataacgatttaattctattttattctttttttatttgattaataattactcaattagatccccatgactttatgtaaggagaggccatggtgtttgcttcgtgaggcggttgtgaggagccatctctgtgaacgggctcctggccgctgaggtgcatttcacaggtgctcatgctagctccctcctcagtgtgggcttggccttgcaaatgggcacaatttgcactaaatgcagactcctatggattttgcaggtagattctagtttttctgaacaatttttgcatttatttctgcatgcgctcatttaaaaattgtgttgttgtagtagagcatgcatactaacattgaccatcttagccatttttcagtgcccagttcagtggcatgagggcatttacactgctgtgcaggcattttccaccatccatctccagggcttttccttatcccgaacggaaactgcgctaattcaacacgcgctccccattccctcctcccgcagcccctggcacccaccattcaactttctgtctgtgagtttgatgagtctaggaagctcatctcactggaatctgatggtatttgtcctttgtgcctggattattccgtgtagcataacatcctccaggttcatccataggttcatccttgttgtagcctgtgtcagaatttcctacccttttaaggtggtgagtgctaagttttaaactgattgccttataagccaaaatgttagaaaccagcctattttcacacaggaggctgtgcttccagaaatctgcctaaccctgtcacgttgctgtgtcacgccatcaggctcttaatgagagcacatgaagaaaccacagattttggagttagacagactccagttggaatcctagctccacaaccacctgctgggtgaccttggggacattatttcatgtttacgagattaggacaggaatagtaaatacctcatagtgttttgtggatcaaatgagctaaggtttaaaaagtgcttagctagcaagggggagaggtcagcttcctaagtgtctgccctcccctggagtgtggtatcatcactgtcactgttgcacgtgagccattttaaggaaaaggtgtgtttttcaggttatctttcctatgccaagagccataggagtgcattgacacgtgcagaccccgcaggaactgtgcattccccgatggcaaccgtgttcactcatgcttctgtctttcccctccacactttgagagaatgggctgacattataggttttttttttcttttctgtttattttttctttttctgttttttttctttttttctttttttttgagacgcagttttcctcttgttgcccaggctggagtgcaatggcaccatctcagctcactgcaacttccgactcctgggttcaagcgattctcctgcctcagcctcccaagtagctgggactacaggcgcctgccaccaggcccagctaatttttgtatttttagtagagatggggtttcaccatgttggccaggctggtctcgaactcctgaactcaggtgatctgcccgcctcagcctcccaaagtgctgggattacaggcgtgagccaccgcgcccggccgacattatagttttaattaattctttcaacaaatatctctaagtactcattatgtgacagacactttgaaggcgctgtattgaagcataggaacttggtcctgagcaaatgagggacttaatgagagcacatgggcttgcaaaccgtgaacccatctcagggactggaaggctctgacaaaagaggagcgtgagtcccggggaagagagggcagacagttctggatgtggagggtcaagaaacgcttttttgaggaggtgacatttgagcggaggctggcgtgaaatgggggagtggattatgaagagtgccaggggaaatattccaagcagagggaagagcaaattctagaacccttgagtggctatatgcctggcacaccccaagggcaggaggtcgaccacaatggcgaggggatgttggcccgggtggaggggtaggaaatggagtgaggcaggacccggaaaggcaccatggctgcagatttctatcagctgacctttattcactacggttttagtatgagccttgttacagatgaaatgttgtggaggtcctaacctccactgtgctagtatttggaagtgaattatttgggaggtgattagggtgagatgaggtcatgaaggcgtggccccatgatgggatcagtatccttataagaagaggaagagacgccagtgctttttctctgtctccatccaatgtacagactcagtgagaagggagccatccacaagccaggaagtgagctctctgcaggaacagaagctgccggcaccctgacttggacttccagcctcagaactgtgaaatgtctgttgtttaaactactcagccattggtatttcattatggcagctggagcagaccaacgcaagccttttattctccaaatgattctggtgacctctcaagacctttctctatgacgcccgccaactttgtaaataaatcctaccctttcatgaatggacgcagagtgaggaagagtcacttccttcacactcaggagcacatatactcacctgctggcccacctcgaggggcccagctaggtcagtgccaggagaggcaaggttggtgcatttcacattacccccactgaccccaccactggtagctgcctgggccccaccagccttcccggaaaccgtgtgcatttgcacttagccagacagcacacggtgagaggcttatttgctcatatggtactttcaagaatctgcagcattgggtaatttgctggccatgtggagattcccatgtgcggggaagggctgctgggctgaggacctgagcagatggtggtcattaatagcaccaacatgtgaccagctgtaattgtgctggaaggactgaagccactgatggttgctccgtactttggttctacttaaaaaatacttttagcaggacataattcattatacaaggcagcattagcaaagaaatatcagactcccagtaagtgccattttcctacccctgtgttttaacaagtattcctggtgtttagaaatacatagtctctcagtcatcgtgtgggtaaaagtgagaagagttgtttttctcagtggatcaagactaagtcttatgagatttgaaatctagaagctctgctaaaattgcatatagcaatgcctgtgaatatgtgaaccgaatgagaaacacatttgtgtcctagagcagaaacttagattcagctctttatacacacaatgacccctcctggttaattgacttgcaatggtagtttcaggtatccagcagtagttctggctacagcagatctgtctacccactgcctctaaagctaatctctccagttaatagcttgcagcctgggcctcattaagtcaaagaacttctgcccatacaataggctgtaatcctctgtattagtatgaggtaatttggctcctaactggggaatttttctcgtctaataagaggagaaattgtttggtacagtagaaatcatatagtttcccagcatttggctcttggagaaagtcagggattctgtatcctgttccttacctctggagggattcttaagttgttttgggtatcttacagcaaacacttttagtgacaaacaagtcaaattaataataataataaaaaacctaacagttgttgactactgcgtgcttaagaagagttctgagccattttcttgcatgaactcataatgcccacaacaactctctaaggcaggtattcttatccacatgttgcatacgaagaaactgaggcccagagtgattaagcttcatttaaaaagcgtgaaatggggcagtgagtcatgaacagtgccggaggaaatgttccaagaagagggaagagcaaattctagaatccttgagtggcaataagcctggcacatcccaagggcaggaagtggaccacaatggtgagaggatgttggcccacacagagcggtaggaaatggagtgaggcaggaccagtatcgtaccagtgctaagataaaagcccaagcagtctaatttggagtccagactcttgatcattgatatgatttggctctgtgtctccacccaaatctcatgttgaattgtaatccctagtgttccaggaaggaccaggttggaggtgattggatcatgagggcagtttccttcttgctgttctcctgatagtgaatgagttctcataagatctgatggttttaaagtgtgctgtttcccccttcgctctctctcaccctcctgcttcactgtggtaagacgtgccttgcttccccttcaccttccaccatgattgtaagtttcctgaggcctccccagccgtgtgaaacgtgagttaataaaatctcttctctttttaaataaattacccagcctcagttagctcttcatagcagtatgaaaatgggctgatacaatcactattcaatatagcttctaaaacatacatttgtattatagcatgctagaccaggctgtgtgagccacttgggcactgcatggatttgggtgagccggggaagatgtcaaccccactgtcagttgttatgcaaaggggagccttgtcttcatcctaagttgaaatcttagggactgtctcttctggacataatagaagtgtgtcctgtgtccataattgtaaataaacttactggcatatagaaacagtgcctggtgagctctttttgaggatagatgctaggtcttctctttcattctcaggacccagcacaatggtggggccactcaaatgtttttgaatgaatacatgccatttttttggaagctgtgagagtttatacatcatttttcacctattgccagacatttgctgtctccatatcttactctatacatgaaagcagaaagtagaataagccattgtatgatttcagagggagaagtgaggaaatgggaggtagctgtgtaaaattagatataaactaccatcaaaaagtaattgatttaaggccctcttaaaaacacattgtcttagctttggctgctatgacaaatgaccatagactggatagcttaaacatcaaaaagttgagaaaatttatttcatacaattctggtggatgggaagttcaagatcaaggtgcccacagacctggcactggagaggagggctcccttcctggtttgcagatggctgccttcttgttgtagccttacatgtcagaaagagagagagaagagaaaactctcctgtctcataaggacactaatctcattcatgaagcctctaccctcatgacccaattaccttttgtattagtctgttttcacactgtcataaagaactacctgagactggataatttttgaagaaaagaggtttagttgactcacagttccgcatggctggggaagcctcaggaaacttacaatcaaggcagaaggcaaaggagaaccaggcaacttcttcgcaaggaggcaggaaagagagcgagtgaggggaaactgccacacaattgtaaaccatcagatcttgtgaaaactcactcactatcacaagaacagcatgggggaaaccacttccatgatccaatcacctcccaccaagtccctccctcaacgtgtggggattacagttccagatgatatttgggtgggaacacagagccaaaacgattcacctctcaaaggctccacctcctactaacatcacattgggtgttatgatttaaacatatgaattttgttgggggacacaacattcagtccataacacatgtgttgataattacaactcggttccaagaggtgcctccataaaaggtcacagagaccccaagaacagagctgcctagagttctattgcagaactccagggttgcagcaattaattttacatctaaaatgttgctgtaagaatttaccccacaaaaattgatcaatgggatcacttggacacagggcagggaacatcacacaccagggcctgtcaggtggtggggggctgggggagggatagcattaggagaaatacctaatttaaatgatgagttgatgggtgcagcaaaccaacatggcacatgtatacatatgtatcaaacctgcacattgtgcacatgtaccctagaacttaaaagtataataattttttaaaaaaagaatttaccccacaaaaatgtgggagatgtaaagagaatagaaagcttgtctttacagaagaatgctccctaataaatatagaaagcattgtggatatagaaaagcatgattatgcaattcccaatatcataattgattaaaccaaaaattagtgaatgctaaaaattattgtcatagattattggggataagatatccatagaatattcatgtgtaatttcacagattcttattagtttaacatgaaaatattacctgtctaatggagaggtctagtggacacaacttaagccaatagccaaactaagcattgccaatattgggtcaaaatatgcgcttcctgatatgaagccatctgccacccaaaatgccacttatgtacaattactgcccaaaatgtttaagtgaatctaatcatgaggaaacaagcagagaaatccagatgtgggcccttctacaagataactggcctgattcttaacatcaaaacaaaattaaaaaacaatgtcatataagcaaaaagaaaccaaccaaaaagtaatgaggttgaggggagaatatactaaattgaaaaaacacacacaacattaaccttaattgtttcattgattaaaaaaatagatgcaaaagacattttgaaaaaattggggaatttgaattggggctgaacacctgtgttgaatgtattaggtgtggtaaaagaggggtaagagtagggttgtgttagaataaaagaaggtccacattgggaaacacacgctgaagtattttggggtggtgtttgcaaattattttcaaatggcttagcaaaaagagtgtgtgtgtacacacaaatgtgtacatatatgtgcatatagagggagagagtggaggcataattgtagtaaaatgctaacattggcgacatctacatgaagtgcagacaggtgttcattgtgttctccattcagcttctcctggaatttgcaattctttagcataggtagcatggggcaggtgggaggagatcatacctgtgcacaccaggtgaatcccagttgggaaacggcaggtgagtcctggggacatatgtgtctctgctagagcatccttctctttgctccagtgctatggggtgcagacgggggacatccattcatgcttttccttcttcacacattcccctggtacctttttgctggcagggaacacagtccagtgtctgggctgcagatccctcatggtcagaagaggggtttggtgagaagtgggagactggttgctagtcctgtgagtgcatgccagaggccatctccttggttcatccctgtttccccagttctgggcacaacttgcctgtgtttgccaggaatgcatagcttatctgagcttcctcatggggtgagtgggtgaggagagatggtgttatcatcaactgtcaaagctggaggcttccagaaatgacactgctgtccagggtggatggcagatgccatctggactgtctcatctcagtgtgcaggcctctagggacatcctgccctgggcgtggggcttctctgccatgagggggatcctggtgctgtgagtgtatcacaggtgatgtggcaaaggtgggcgtgggcaccagatacagacatttccagtgggatctcgttgtactttcatacatgtcactgccggactctgtggtcttaaaagccatgaagccagcccaaggacccttgccgctccatgccaggcagcctcctggccccgtctgactcgccttagggggtgccttttactccgttgtgtacaaagcattttgaaggaagagaaggaactaacagttagtgttgtcagtattctcagaattttggcaatatcccataataagaaatctgtttgatcaactcatatacacctacacatgtaatgcctctatatgggtctgtgtgtacatatcggtatgtatagctgtgtgagaggatctatagacatatgtgtgtatgtgtgtatacacatctataatgtatgacaaaagtttcatcagaccatccgtacgctcacactttgatgtttactaacatcaaagcattagtaaatcagtatttcttaatgcgctgcttgttactggtttaggctacttatgatccgaaaaatgctggtttcagcaacacggaaaacataaaaagataattatagaacagggttaggaaaccaattctgtctgatgtgtgtgtattattacatgagagtatttgtatgtatccatgtatgtgtctgcatgtgtgtgtatttccatttatctttgcaatggtgcagggcaactgtgggtctgctgccattgtgacttgtttctgtcctctcctgggccgggcccttcaaaaactgtggagggacatttgtcattggtgtccgagcttctgtgctatttctccagaggggtcatgggatgacacagagaggccctgtgctgcaggtaaatctggaggacagcttgcgcccagggaaattacatgcaaaccaggttttcctgtcctcttgagtggggcttttttctttcagaaacccccctttttttttcctttttttttttttttcaatgatctctgcagaagcagcagcatggggctcaaatttgaagtgagccgcagatgcaggtttgcttgcgagtgactccctctgctcaaaatcgtccgcattttttttcttcttctgagacagggtctcactctgtcacccaggctggagtgcagtgctgcaatcttggctcactgcagcctccacctcccaggttcaagcaattctgcttcagcctcccaagtagctgggaccacaagcttgcgccaccacagggcatcctgtatttcaagcttcccccttttgaaatgaggattgctgacggatggtgtgcaaactttagaacttgttgtcaagatgtcagttgaatcttaattaaccattgaggcagcctgggagatacgcctattctggtaggaatttttattctttcaagttcaaggatttgtccttcatcattttccaatccatgggatggtaacaataaaaatagctaatagctaacaaatgtttactctgtgctgcgctcagcgctcagcgctcttcatgtgttttttctcctttatttgttagggaatgaatgagctcactagttgccttcttctgccataatttttcttccttgttcacatgtggttggtggtatatattttagtattcctttttgtttgtttgtttttgagacagagttttgctgttgttacccaagctgtagtgcaatggtgcggtctcagctcacctctgcctcctgggttcaagcgattctcctgcctcagcctcccaagtagctgggtttacaggcacgcaccaccacgcccagctaattttttgtatttttagtagaaatggggtttcaccatgttaaccaggctggtcttgaactcctgacctcaggtagtccgcccgccttggcctcccaaaatgctgggattacaggcttgagccactgtgcctggccaatattccttttaaaatctcaaacctgccaaaacatacaggagggagaattattagctcatcagattcagtatatcaaaatgaacctgctgacaaggtggaacataattcacagactacagctgttattaatgtgtgactatttctggcaaggcccagggtgcacaatcagaaaactattaatatataacaggctgaagtggaaatgtgaatgagccaatacttggaattcctatagtatttacactaactgttcctctgcccttctgaactgagtacttcgcaactcataaaatacaatttcctgttttccactttgcagcctcttcacatctcctatttcttctggctcctctaattaatggaaacacttgcatttgagttcgcatcgatttgcaaaacattgtttaatatgagaatattttcaccgtcgagggcatgttgattattcctaggtgtaaaacattctagtcaaatttaatataagaaagtaacatgcattgtcaataattacatgaaaaaatatggtggaagatttttttctctgattaatgactcaacagttttaaacatgtgttagtgggctgggcacagtggctcacgcctgtaatcccagcattttgggaggctgaggtgggcagatcacctgaggtcaggagttcgagaccagcctggccaacatggtgaaacccagtctctacaaaaaatacaaaaattagccaggcatggtggtgcgtgcctgtaatcccagctacttgggaggctgaggcatgagaatcgcttgagcccaggaggcagaggttgcagtgagccaagattgtgccactgcactccagcctgggtgacagagtgagactctgtctccaaaaaaaaaaaaaaaaaagtgttaatgaattctttaaaataatacccatctcttcgattcatgaaaggattctttaaactcctctgcaagagcctgagtctgcccagcatcacggtgatggcctccatggtccctcttgctcagggagcagctgctttgcacctgggactctgcacgctcaccccattcagtctcccgggtgctccctggcaggtgcaccatcatcctcatttgatggtcgagactggagcgctaagagcgttggtgcacactggtgggacccaagctcaggtgtctgtgagacaaggactctgccctccagtaatgaggaaggtggcatcccctgtccctcaggaagattattgtttatttgaggaagtgcggtgtaaagacctgaatcaggaaaggacaagtcaaggcattgtggcatccaatggcatcttaaatgcctctgggagaaggaggtcactgggattgagaacattcagaaaagatttgtgggaggaggctgaacttgggcagacacttgaatgaaaaggatgtggggagtggaaggagcaggcattccctgcagtggggtgctgagattcagagaaagaagaggtgcagggtggtgtcttgatgaggcactaagaccagctcacaggccgatgagggtgagatctcgaaatctgtctgttgtcacactgcctctctatactaacagttttttagtgaaaaacacagtgagaaccagataagtgagttcactgaattttatttccaaaaaaatggaaagctctagtaacgttctgcagtaacactttggctcatgtctaagttctttttttctttctttctttctttcttttatttttttttgagacagagtctcgctctgtcgcccaggtgacatttctcacaatagcaaaagtttgaaatatgagtgttcatcagtagtggaatgattaaattagggtacatatagacagtgggatactctgaaactgttacagatgatgatatagctctaaaggaaattgtctatactatattcttcagtgaacaaggtaaattagaaagtattatatagttttttaaattttatttatttatttattttgagagggagtctcgctctgtcgcccaggagtgcagtggtgcgatctcggctcacggcaagctctgcctcccaggttcacgccattctcctgcctcagcctcccggtagctgggactacaggtgcccgccaccatgcctggctaattttttatatttttagtagagacagggtttcaccgtgttagccaggatggtcttgatctcctgacctcatgatccgcccgcctcggcctcccaattttttttctttcttgcattatgcatttttcatcaaatgcttggcttcgtgccttctaccatgaagaccccacttcacagcgacacatgctcttgggtcactccgccacccgtggggttgtgaatcaagttcttcagggagagaagacaagctgacaggggtgggacttgagttctgtgcatctgtgatcagattccgcctccacagtgctgggtggtgggaggaagcccattcatctctgtgagactaaagtccctcatctgtcaatcaagatgctaaattttatttatttatttatttagagactggcccttgttgtgttatccagagtggtgtgatcatatgagatgctaaatattccctcgtgggttgtcatgaggttcagctgcaaccctggctggcacaggccatgacacttccagcaatgtacctgcccagctgggattaatcactgacatttaactcccagttgatggcacctgtgtacggatgaattcctcaaaacagtatcagaatcttacgtactcactggtctcagcgagtattcacagagaaagcaagaaggatggtatttgattactcaataagtgagtcctgaggggtcattgctaggcaggctgaggggtggtctctgcagcccctcacagcctttgaacagccagaactttgattgatgaacaggtgctttcctgtaaaaagcaagaagcactatggaatcacagtttttgttgattttttcccctgctggtagtctggtcttcatgatatcattcttccagaaagccaaccctttcttgcaaaagtacaaggtgtgctcaggaaaaatgctgctagtgccaagattcctctttccatttctgtggccctcaggtgtggacatcgctgccttattttccctaaagtgacaaacaggatcacatcacatatttaaactctgaaatcggtattatgaggtttaatctgtatccatgtaggttttatcttgttgcaactgtttccatcctctcgcatttccagtgcccccatattgaccaggagcaccatctaggcatccgtttgtgttcctcctgccccccacccccaccatgcttctgtctgtcttctccatgagtaggaggaggtcacttggatcgagaacattcagaaaagatttgcaggaggagactgaacttggagagatgcttgaagggaaaggatttggggggtgtgcaagagggggcattccttgcagtggggtgctgagatacagagaaggaagaggcttagggtggtgtcttgatgagacactaagactggctcacaggttgatgagaacgagatctagaaatcggactactgccatgtcagctcacttcatgaatatcatgaagaccagtccaccaggaggatccaacaggaaggcaacttttttaagcaaagggattctagctctccactggattaccctgtttcatatgtaaaagttaggttaactcggaacaggagatgcaaaaaccccatctacttagagaaagctgaggagaacaaaagtagcgttagctggagacatatgccatttgttggagtgtccactgagctcgtgcaatactggttgaagccacttctcacagagatgaagcaccccgtgggtgagcctggaaataaaagtgcatggagccaggctgtggatgacggaaatagtaaatggcaaagcagaggagggcttgagcatgggtgggcaggtgagcaagcgtgcagggtgcagaaaccacagctgtgagaaggggcttttccagagtgaggttacagaaagatcaagtgaggcaggacagcatgtggacctggaagagaacataggcaaggggcgaaagagtgtggaaagaagagaaaatgaagctatatagacttcaagtaacagcatcattgctctagaactaggtcattcttggtctctgagctccggacaaattctgaagtgacctacatcattcatagaggcagaaggaggctaccattcattccagcaagcagggaaggctttcttgatatgtgctggtcccagactaagcctggaacacagtgacacacagtccttgccctcagggaactgaaagactaggaggggagggagtcatgtccataaattcaaaggccatagttgctgcaagatggcaatgagatgctaggagactataggtgggttttctagccaagtcttgggagaattcaggaaggcttcctggaagaggagacatccaagccaaggctgaaagagcaggagcccagcaggtgggtgggcccaggccatggacatagcatctccaggaggatcatgtgatccacccagactctcatctatgttgtttgcttttaccatgtagggtccctaccatttattttctcatatgagtgaagctgtctccttcaccagcccccacattatcatgtactgttttcatccagtcctctacagcctccccccaaccgagccccacagcccctgctgccaaagggattactgtaggctttgggacattctggactaatcccacgttcttcacccccttttatgtcagtcaccaggagaagctggtgactaaccacagttggtagctctttgtacgccataccttccccgactttctcttctgcttattttttctgtttcttgtttcacaatctgacatctcatgtgtctggaaggtcagctccatgaggtcaggaattgcctacttttttttttcaactgttgtacactcagcacctagaagagtacatggcatgcagtgggtgctcaaaacacagtgattgtgctgagtgcaaaggctcagcctgtaatcccatcactttggaagaccaaggggggagtttcacttgagcccagaagttcaagaccagcctgggcaacatgacggaaccccatctctattaaaaatacaaaaaactagctggatgtggtggtgcacacctgtagtcccagctacttgggagctcgaagtaggaggattgcttgagcctgaaaggtcgagctgtaatcacaccactccagcctgggcaacagagtgagagaccctgtcaaaaaatatatagtgattgaatgaatgagttatactgctaaatggtttaaacaattatctaaacattgtttatgttcttttgagactttgaagacattgactttcaaatccagtagtttccaaatttaatcatcagaattacttggagcactttttaaaaatgcccaagtcttccccccaaaactcttggagtagttacttcaggatatgcgactctgagattttggttttgattcagatataatccaggcattgggaccattttgcaaaggagagagtagaccagagataatgagtgcattatctctgccagggtctgctggggagaacctgccctgatgcccaggccagcgtgctctggctgcctggcttatgtctaacaggagctggagggcatgagggtgggacgctactgttcacatcacagggaagatgtgaatgggggtggtttggggtggagcgttgaccaggcttttaagagaactgtgggtttatgcctggtaatgataaaggaaagtagatttcaggtgcagaaaacatatccgttgtcatttaagtaaagttagaatcataggtctgagataatttaatagacttttccatttgtcaaagatgtatgtcttatttcccagtgatctctttccttctcaaatatacttgctactacaaatgacattccaagagcccatttcagtcccctgagcgttttgatttttctttcgagcagtagacctgctgtagtttaagctggttgggaaagctgtcgttcaccttgatggattaccgtccccgcagtgagcacccagtctccagaaagttcacggctccctcaccttatgtatctgatttatgtagaaacgtcgataaattagttaggagggcattcttgctgatatcagcaatcccagagcacctgggaggaaagcagagtgaagattttgaaagtcacaggcgatgtcggccactctcctgtgtggcccaggaacctcacacaatgataagataaggaagtttaatggatggtgctgccttctgaaagattaatcgtgccttgaaatctagatattttcatttcaggctgaaaacagtaaattagaaattaataaaaaggagatgatttcatcagctcaacaagtgcttctgatttcaagaagttttccttaaattttttttttcactgctgaaaaaaatcagtgtcttgataattttatgaagtagcctgtaattatttcactatggctttgcatctgagaactgaccatttgtgttttgaattcatgtcaaacaataatatattcgatagcattttatgatttattttagtgcctaaatatttataaaacaaaggcagggttttttattttcaaatttatgagctagataatgtcttgaagatgtacaacatagtatactaattttccttgcattctggcagtcctcaaaatgtaataggcaagtttattcttagacaaaagcccatttaattaaaactcacacgataactttcatacatagcaattgaattattcctaaaaggattaaatacctaagctttgaagttggatgggtgattattacaaaagccagattaatacaattgacctaatttctagtcagtgacattataagcagccttgtaagaatagctgttactacaaatatgcgggtttgcaatgttcaattctaaagtggtctaatttgttcttactacctgccagaatgtatgcattcaagtgggtgtcctccatgacagctttaattggtagtacaatggtatgagtgtggaaaggagctggtatttttcctgtttattcattaattgaacaattgattggtcatctactgcatgccagttagcttattaggggctcagatgcaagtgggggaaggtaataatcaacaaggaaatatctgtcatgtagagaaataaaggaaggtagggtggagggttaaagtaagacaggttcagtattccactggggatcagggagggctctcacttaagtgaggtaggttgaccatggattacctgggggcagagtgtgctcaagcagcacctgcaggccacagggaggctttgagttttgttctgagtgagattggaaggtgttggagagtttgagttttttttattctttgagattggaaggtgctgggttttattctgtgagattggaggtattgagtgagattggaaggtgttggagagtttcaagcagaaaaactgtaagatctgcagatgttttaaatagatgtctctgtaaattgtaaaactgtaagacatgggtaagaagcaatcattttcaggggtgagactgcttgtaggacttcacatgagcaaacgccaggcagagtgtggaacctggacccttcaaagagaaacgcaggtggaagaagcagcaaggaggaacggggcttagctgggccatcgccgccgtcttctctggcactgcccctgtgttttccgttcagagaaaagcctttcctagcattcatgacccccatcctgtatcatccaggttccacacggtcctcttctgagagaccctcccgactactcctgtgcccgttgccatgccatttgttggatcacttgcaggccccgagtctcaaacacatgatttatcatcagatcgtacagtcgtcagaagggtcccaccgtttctaaccatgtgacctgggcggttgctttacttctccgcacctcaatgtccttgtctgtaaaatggggcggatcagcccacctactgtttgggattaaatgaggtgatgtgcataaagctgtcagtgccatccctgggctgcagcgggcgttctggaaatatcacagattaccatcactgtccgccgcgcggcatccgtatgcccttgattcatacacagtgccacgcgtgggggcggttctcagtcagaaaataccaagagcagccgccgcatcttagaatttgctgtgttttactcagtccttttggggtgtcagcattttgttttctgtgtgttggcagttgatcggtaatttccaccgatgcccctgtacctcctccatccccagtcttcccagtctgcatggcttcaggtgtcacttctgggttcatgtctgctaaatttatgttggtagttttagactctcctaatcccctacttggcgttcctcatcattggtaggcacatctctgaatgtgcgtctttccagacccaaattcagctcgtcttaaactgtactcctcttaaaacctatttctccttaattcaggttacagggaacactgcctcccttagtccatcatttgggcagcttcggtcaataaccctcccctgtggttcctcttctctcagatttcatcccctctgtcctgatgaagcccctgcttctagcctctcaccagctcctcttgttcatcttggctatagatgcttatcagcaaagatgttggttcttcccaatggtgaggataaagtgtgggtgctgatgaaggcaggatagtgacctgatgtagggttctctgggtaaaacacaatgtttaggattcccctctagcacaaggttgctttaggtctcggagatcagtgcaccaagagaacagcaaccagcagtgacctctcctaatgacagtggtcatactagtatgaccatattaccagaagaaagaagagaggttgttttttaaagcactggagattccatgtcagaaaatgtgctattctggccgggcgcggcggctcacacctatagtcccagcactttgggaggctgaggcaggcagatcagttgagctcaggagttcgagaccagcctggccaacatggtgaaaccctgtctctactaaaaatacaaaaattagctgggtgtgtggcacacacctgtaatttcagctactcggaaggctgagacaggagaatcgcttgaacctgggaggcggaggttgcagtgagctgagatggcaccactgcactccagcctgggtgacaaaagagagactctgactcaaacaaacaaacaaacaactgtgctattttaatagatattcaactaagaaatgggtgggtgtaagtgatttaacctgaacccatctcagcagaaacctcagttgatgaactttttcttttctttttaaacccactttaagaagaagtacatgacaataccgcagcccctggaggttatttcatgcaggtggagagtggattcaccacatcctccagctctgagaccggtgttcagtgagaggtggttgtgggctttgagtctgtgagatcttcagtcatccaagttggattttgtttatttgacttagggtagatgttggaccaatacctcgtaggaaggtttttgaatcgggagttgaagcaaagcagcatttcttgttagtcctcagttaattagaaaattaaattaactacaatcctcattcccagagctttctgggtaattgatgtcttactgtatttggattagagaaggccccaggaggcacaaggttataattgtgtagaattagagaatctagggaagaaggaatggcaggtaatttgcaaaatttcaaggcagggggccctccccaaagtcccatggcaaaggcattgcttggtgagcacgcggggctgggccagaggctgcctactcgggagacatcagctgtgggtcaagagctacttaaaagagaattcaggagatcaaagtattgtcttccaccattcatcagaagaaaatacatctagatttaaaccctggaattagactggcttgatgcttttaatttgcatttaaagtcttaaactttttcttcttccaaatatttaccattttctgtagtccttttaagtatttggactagacttatttagaaatgtacagagtgcagaacaatgtagactcttgagtggctaagagtctaaacggctgaggaatgtagatcatttttggacttaaaatgaagctttaactgcccccaaatggaggacctccttttctggaagcaaattgcaatctgaatgctctgtgctaaagcttaaagcatagcaggagaaactattagaatttgtatagtagcattgccttggacgagcctagtgcaaactgagcctggtatgtggaccaagtactgtttatgacttttctttaagcataagttactcagggaaagtattatcaaaacaaatttggttataattgtcttcagacttgtttttctgggacttgggacttaaaagaggggagtaggctgtggataagctttggagttggcccacacaatggagattgttcaatttttttttttttttgtcctctcagacccagtaactttgggatttttattgactacttttttctccaatttttaaaattatggtaaaatatatataacataaaattgtccatcttaaccattttgaggtgtataatttggtggtattaaatgcattaataatgttgtatgatgattaccaccatctatctctgcaactcttttcattttgtgtagctgaaactctgtacttactaaacaatctcttcattcctccctcccccaatcgctagcaaccaccatccaatgttctgtctccatgattttgactactcttaagtaccttgtataagaggaatcatcaagcatttttctttctggactgccttgtttcacttaatataagtcctcaaggtgcctccatgttgtagcatgtgtctgaatttccctcaatttttagtctgaatagtattccattgtatgtgtatgttacattttgctcatccatttatcagttgatagactcttggtttccatccatgttttaggtattatgaataatgctgtataccagaagtggaattgctggatcatatggttatttcatttttaatattttgaggaaccatcatactgtttgccacagcatctctatcgttttacactctcaccaacagtgcacaagggttcagtttctccacatcctcactaacttattttctgtttgtttgtttgtttgtttttaacagtagccatcctactaaagaggatctcattgtggttttgatttgcatttccctaatgattagtggtgttgagcatcatttcatatgctatttggccatttgtgtaccttttttggagaactgtctatttaaaagttctgcccattattgaattgagttgttttgttgtattttttgagttttagaagttctctatttgttaattccttattacatatatatatatgaattgcaaatattatttcctctcctgtgggttgcctttttattctattaatattgtcttttatgcaaaattttaaacaatttctcgaagtcctatttgtttatttttcctggttgcctatgcctttggtgacaataaatcaatgccaagaaatcatggacaaaccaaatgtcatgaagttttgccctgtcttttcttttaagagtttcatagttttagatcttacatttaggtctttgatccattttgagttaatttttgtatatagtgtaaggtaagggtctagctttattcttttgtatgccaatatccacttttcctaatcatttgttgaaagaactgacatttcctcactgaatgattttaggacttttaacaaaagtcatttgtccatatatgcaagtttcttggctctctacttaatgcattgggattgcgatagagatggtgttgagtctgtatatcactttgtgtggtgccttacttcatttgggctgctatgacgtaataccatggactaggtagcctctaaacaacagacatttatttctcaccattctggagtctgaaaagtctaagattaaggcactggcagatttcacatctgatgagggtgtgtttatcatagatggtgccttctctctgtgtcctcaaatgatgaaagggacaaacaggctctttcaggccttttgtaaggtctctaatcttatccgtgaacattctgccttcttgacctaatcaactcccaaagtccctcacctcttaataccatcaggttggaggttaggtttcaacatacaaattttggggggaaacaaactttcatattgtagcgggtagcattgacatcttaacaacattaagtcttcccatccatgaacatgggatgtgtttccatttaattatgtcttctttaatttctttcagcaaggctttgtagttttcattttacaagttgttcacctccgcggctaagttaattcctaagtattttattctttttgatgctgttgtaaatggagttgtttttatcatttccttttcagattgttcattgttagcatagagaaattcaactgaatattgtgcatggactttgaaattttgcagaatgtactgattagttttaacaggattttaaaaaatgggatccttaaggtttttatatataaaattgtatcatgtgtaaacagatcattttacttttttttctgatttaaattacttttctttctttttttatttttggtctaattgttctggctagaacttctaatattctgttgaatcaaataagtggtaaaagttggcatccttacgttgttctctattttaaaggaaaatatttcagtcttttgtcattgagtatgatgttcactctgggtttttgtatggattttatttattttgaggtagttctcttctatttctaatttcttgagttttttttttttttaatcataaagcgctgttgaattctgtcaaatgctttttctgcatcaattgagattattacattgattgctttttttaaagtccttatgacttcggaagagaatatacttacgaattgttatttttgaattgacctgatttaactctccagtcactcaaataatggcacaaataaaaattataacaatgattatgtgcttactatgtgcatgacactgtgcaaaacaattcatgttcattatgtagttactactcaaaatacctcctaggtaggtactgctattctttccattctacagatgagaaaccagggctgagagatgttcagtaacatgtccaagccaccaggccaggaaatagtgggactgtgatttaaactctatttaactcctgtgcctgcacttgtgagagctgtgctacacgtgtggacaggacccttattctaatactgtggagtggaaaggaaggaagaaagggagggagggaaataagtataatgatcctcttttcctataacttcagagagagtaattgtccagctagcaccttcctgaaccaagggaatgctatctcgtgctcatattgaaagaaagataaaaagacaatcggtgaaggattgtaatgaagattaaaggagcctggagcacaactttggtttccctgatatttttcattacacagagttattacgtgttagagcacacacaaagtgtattctcggccaggcacagtggctcactttgggaggccaaggtgggtgaatcacctgaggtcaggagttcaagactagcctggccaacatgccgaaaccttgtttctactaaaaacacaaaaaattatctgggtgtggtggcatgcacctataatgccagctactcaggaggccaaggtaggagaatcacttgaacctaggaggcggaggttgcagtgagctgggatcgcgccactgcgctccagcctgggcgacagagcaacactccatctcaaaaacaaaaaaagtactctttttttgcagaggaagaacattataataaatgatgaaatctatgaaacagaatgaaatgggacctgcttttggaataatctaatgaaatagattattttaaataatctagtaagataaattagatttataagataaatttagaagataaatgtaaaattataagataaatttataatataaattagatttataagataaatctaataagattattttaaataatataaaataaggtcaaaatgaaggcacttctgatgttttttttcatgagcattaagcagtgcgcaccaactgaactctagtataaagtggcttaccagaattataaaaagactgcacatgttcaattttaatctatatcttatgaaaatggtaatggaagagacaatctgcctgagaaaggaatagaagaatcacattttagttttaatttctcattgataaacctcctttagaaacgagagagtattctagaatcgtccaattgatagaaaataatgtatttccccaaatgcaatgtctttgttatgaagtcacacctgcactattgaataaaatattatccatgttgtgtgtgacatgatttcagtagaataaattatcagtgaatgacccacaataaatcatatgcctccacttcatgctgttaacacttcatgctgttaatacttcatgctgttaacacttcatgctgttaattcacttctgatggggaagctactcaaattccgatggaaatgttgatgttgcagcatttgggatgagttctaatatgtttgttcacttttaaacactcctgagatgtggatgaagaagctgaccagcaggtgtgtgatacatttgtttgcgctgtgctgtactgggaggaaagaaagcagcaaaggtgtcttctctaataaacaccactctttccccttctagatctccaaatctttctaggtcttggtgcctttgagcctttcagtcaatcttttaaataaaatggtttccaggtgtttattcgtgtcaatttaattttccctaaaaatacatttctagatttttacccaaccactgtgatgccgtaaaatatggcagaattctgggcatggtaaaactgttaggaagaatcagagcaccaaccctagatgtacataatgcgtcagggtgtgaggttgagggtgttaatgacactatattgagacagtatattgagcatctgtgaggcacaggcagtcaccagatgttgtgcatatgtagcttgttagttttgccaatacctctgtgaggtactcatttttaagcccatccctaaaaatgaggaaaccgaggggcagataatttaaataattgcctaagatctctcaactaattagtaacagaatttggattcaatccaagatgatcttaactctaagcattagcatgctacaccatcacactgccagatttacctttgagattcatttgtaggttgtatgcagtgatagtatcgcctttgttcatttgcacatcaaagacttcgtgaccaatctgaacacccttgtatttgggcaccaatgtgatcataagaagaaaacgttatctgccatcatcctatttctttttcctttctattttatggtcatatttttttctccatttcaagtagagggacatccttcatattttctctctctctctctcctggttatgctgttttcattttgcaaagtgaaacacacacaactagcagaaaatgaggtgtgccaggtgcattcacacatcacttgtctcccagagtaccagactctggtgtctcagaggcgtgattctcttgaggggggaaattatgttttgcagaccttgttcatttatcacttctatctatctcagacgttcttttcttaaaagaagcaagactcaggcacactgaaggtcatttccatgggacacacttgattgcttagaaaaacaaatttgaaaaatactttcttcagaaggaaagatattgtttctccagggtaaaatatttctgagggcttgactctttccaatgacgcctttatgtaagctgttggagcagggctcttaattgataagcagctgtgttaataattcacaatgaatagcatatttaaaacgtcaacccagtgttgattcttatggcagtatctgaggcgagagagaccaaagcaacaatgacaatgaatctttagattctggaaactcaggagaagccacactatctctagagtcaccaccttccttttttaaagaaagagggaaggttcccctctccaaaggaaagtttgcttcccaggtaaccgtgatctttgtgacctattactgatttcgtttaaacagagtctttatgttcaaatgcaactgtgtggtaaaatggccccagaatccagacatctagatcatgcctgtaacacttttcttaatttttgtatttatattggataactcatgcaatttttcaaagactccattattatttctataaaatgaagataatcttacctacacggttaacctcgcagaattgttggaaagatgaaatgaggcagtcatatatggattagaaattggaacctcctaaactccaatgccaggtgttagtttctttacatctttcttgtagtcaaaaaaaattctgggtaattgttttgagcagttatattgagaacatcctctgagaaaagaactgtgtgcatcttgccatggaaaagaagtctgtctctgcacgtaaattacctgatagggcatgagagttactgcagagaggtggatgcatgggagaacgcaggggtgggggagggacccatcagttggtgccttctgttctgccccatttggggtgtgcactttaaatggctaagaaaggatatcatttctattcaggtggagggtaggggtgcttcatggaagagactgaattttaacttagtcttgaataatagatacaatttactgaaatatgtatatatgaaaatatccttcaagggaagagagtttgccaaggtcaaacaggccgagaagtctaggtgtgttgggggaaggctgagaggtgcaccttggagggagtgcaggtgtgtgtgggaggagcatagagtcttgctggacagagacctccaggggcatttgaatactgctggaaattatttggtgtgtcctggaggtaagagagaccagggagcagtttgtctgtgcaggaagcagtggagtgtggtctgcatgccctggagaagccaaggcctgagggctctccttgcgggagacgcctcctgactctcactggccacagcaaagagaggtaggtttgctggctggaagcataaacacagccctaagtgccacatctccccagagatggcgtggagttcctctgagggaggacatggctccacgccatgttttgagcacaggtgaggcagtgacttatgagggacaatgaaaggtcaattcaagctttaggaagtaggtttggacccaagaatctttttaggtgatctctgaaattatgatcatgaatgagatcatgaggaaaggctccttggatttcccactggggccattttagcggctgcccaccagatgccatgattgactatgttattctttttatttggtgccaaccagagaatcattttatccagttcagatctcccattagtagctgatatgagtttggtttagaataagaaaactaactcttagccagataggcaagcatggaatcacacatacacatacaaaatacacctttggagatagatatttgcaggtaattgttttgaaacaaaatttttccatatattttgtaaaattttaaatttctcattgtatgacattttattataacagaaaagaaccatgaattcctcttaatgaagacctttcttgtcttcactgttattatcctaaagatatttatttagcatttggtgtagtgtaagatgaattgcacagctaatttaaatgtattactggctgggcgcagtggctcacacctgtaataccagcactttgggaggctgaggagggcagatcacgaggtcaggagcttgagaccagcctggccaacatggcaaaacctcgtctctactaaaaatgcaaagattaggtgtggtggcatgcacctgtaatcccagctactcgggaggctgaggcaggagaatcactcgaacctgggaggtgtagggtgcagtgagccaaggtcatgccactgcactacagcctgggtgatagggtgagactccatctcagaaaaaacaaaaacaaaaacaaaaaaaaaacaggtattactggctgccccctttggaaacagtacaccaaatttactgtgcctgattctaagaatagaaaattgaaggatgccttagagaagaaatagagacattttaaaataatgacaactttggaaaatagcacccagaatcccgtggcttaactttgttcagtacaaccccaaattattgatttatgattttttgaccctgagaaaagatgcagatgcagagaaaagatgtagaaatccctccccttcccctctcctcctgggagccacatagggtatgaaagtggtagagatcctttctgctgagccaatagtcgtctttaaaactctgggatccccttccttacaccttatacaaaaatcaattcaagatggattaaagacttaaacgttaaacctaaaactataaaaaccctagaagaaaacctaggcattaccattcaggacataggcatgggcaaggacttcatgtctaaaacaccaaaagcaatggcaaccaaagccaaaattgacaaatgggatctaattaaactaaagagcttctgcacagcaaaagaaactaccatcggagtgaacaggcagcctacaaaatgggagaaaattttcgcagcctactcatctgacaaagggctaatatccagaatctacaatgaactcaaacaaatttacaagaaaaaaacaaacaaccccatcaaaaattgggcaaaggacatgaacagacacttctcagaagaagacatttatgcagccaaaaaacacatgagaaaatgctcaccatcactggccatcagagaaatgcaaatcaaaaccacaatgagatgccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccagacgactataaatcatgctgctataaagacacatgcacacgtatgtttattgaggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaatttggaaatcatcattctcagtaaactatcgcaagaacaaaaaaccaaacaccgcatattctcactcataggtgggaattgaacaatgagaacacatggacacaggaaggggaacatcacactctggggactgttgtgggttggggggaggggggagggatagcattgggagatatacctaatgctagatgacgagttagtgggtgcagcgcaccagcatggcacatgtatacatatgtaactaacctgcacaatgtgcacatgtaccctaaaacttaaagtataatactaataaatttaaaaaaaagaaaaaaataaaaataaaaataaaaataaaactctgggatccaaaagacagactcagtgatagtttcccaatactgttattgggaaagcaataaggctgaataaaaggaaagacccttaaataaagtagaaaagatttgcatgtgacaaaactggaagcagagaaactttaaaagcacatacattttgttcaaggaacaactatagttcttagtctcagagggatttaggcatttgcccaagattatgatgtgtaaaacagagatgctaatagctaattatcagagttatttatatgactgtgtcaggtacctgcctgaaaatgctcaacactgtccatcagtaagtaagagcaccagagaatgactgtctcttttctttgtggttctaacgtgtcacccacgttagttccctggactcagcaggtcgccaccgtgaggccccagcatttgggtccatcactggcgatgtgctgctggcctcagaatgtctgcctctgactatgcaggaggttgctgtgtgatagagtgcgggggaatcaggacaccgcccaccgctgtccaaatgccaagtggcgattcaggtaccttaggaggaaaagggacatggtgaggactggagttgcggtagatgcctcctgggtgttgaagagtccgaaggatccagaatggcagagaggggaaatgggggcagccatgcatgaagacaggctggggggcgctaatgcagctttctctcctggagcctctcatctccacctgctgcggaagctcctgtgcatccaactctgggctgggaaagcaaagagcactgggcaatcacgcctttctctgctgtctgcacgtggcgaaaatgaaagcatttcatggaacctgtttggggcacgtgaagagtgggccagagtgccagggaggcagcaatctgcaggttgcgttcatgccgtgacagtccattcaggggtgcaggagctggtagctgagttccccttcctgttttacacttctggtcttttggttctcaatacctcggggtgtaaaggacagctctttatttggctgtgaatatccaccactgtcttcctacttctctttctttggaagcatttcatttccttttctagaaaatttggagctgaagtgctcggaaggccactgattttaagctcattaaactcacattcacctttgtcttttgttgaaaaaagttaatcttgttttccaaagggccacaggaggatattgtatggatgttatttattgtccttcacaaacacaccccagagattagctcattataggttttattcaacaaagtaattattgcagagaggaagctgagcttttagtgatggacttggaagtgatgggtgaccactctcactggactccagatagaaacagaaatcaaagccgctgtctaatcacacttcactcctccctctgcataggactgtaattggtactcaaggagaacactaaatcaaagatctcataaggcaaatattagcagcatgtatcatgtaaataagaataatgatcagaagctacgcagaggagggactattgtgctcaaaagcagtggaagaaatcataaaagaaagatccataaatgttccttgaagacaacaacattagactttataaaataccacacagaaaatcagaaaagagcctagagaaaatatttaccacaaataagaaggattaccatctttgagctacgggagtgcccatatgaatcaataagaagaaaattacaaaggccaaatgcataaacagccaaggacatgaagagatgaatggaagaaagagaaaataggaatgatgaccaggtcgaccagaaacattcaacttaaccagtaatgatggaaattcaaattaaggctaaaaggagacagtttgcttataaaatcagtacctatttcaatagttgtgattcgataaaatggactcctctcaatacttggtatggctgtaattggataaaagtgttctggagaggaaatcaaccttatgttgcaagagcagtaaaaatgttgatatgctctgatacagaaattccacgtctagaaatttattctaagtaacattatgtacagacccaattacaaaaaaaaatgcaccagtatgtttatgatagcaattttttaggttgtaaaaatagaaaaagacatccattaaaaattatgcttagaataagtttagtaataataacaaatgtgttttgtgcctatgtgtgccaagcgtcatacctacataaatatgtgtgtgtacacatatacgtatgcaaatgcatatatttatatgtatgtgtacatttctatgtatgtgaattttttttcatttgatttttcaccaaccctataaagtaagacccattattatcccagtttgtagatgaagaaactatgacttggagagtttattagctcaagcaacaatcatacacccattaaattacatagcgcttcctccagatcttcaggtccagatccagtgaaaaggaaatgatactaggtggaaatccctgtggtttgtttttggataaaagtttcccaatactaggtaaagatgttcaggtttaaataatgttttgtgacgtgcatgtactggtgttttgcttgtttttccttctagctacacatgaaaataaggatattttccttgttactataaaagtattacatattcctttaggagctgctttcccccccttgtttgtcgtctcttaaaaaaagcattttctaagcagactgagaaaggagtctattaacaagcaaattgcatttgtgagtaagctgaagtgtagggagtggtatttcccactggggctctggaggctcagctccccagtgcagtggctgaacagggccaggcagtgtgaggggactggagctgggcactctgctcagggggtggacagagaagggaacctgggaaggcccccggcaggcaggactcagaggctctcaaactgctctcagatctgcaggactggcttcccacaactctgttcatcctcctccatcgcaaaatgaatatgtaaaggttttccttttacctgccaaagacattttgggaaagtaatgtgaagatttgtactttgtgaatggactcatatttatgtgtacaaaagcatgcagcagtttaaggaatcctatggtgaatactctgatacagaaggaagaattatttgaaatgcgatgcgtaacataaatgacctttcaactgaagttaacttagatactggtacattaagttttctaagaaataaatataaataaatcttatattaatgctagctaaaggcaaaccgggaggcatgctgtaaagtctatgcaaaatctggatgctcatggagaagattcttgtcaaatgtcatgtattattagtataggtagtctcacccttctaaaaaaggaaaccagaagtttgccagccaacctttaaattttgaaaaggtaagtctacagtgtgcttttcatacggttttcaaaagcagataaacattctcttttattaaacacacttctcaatttagtcatggtttgtggaccaatgttttcttaaattatttcataataattttacaacactgagaactggctgtgaaatcaacctttgggaaaaattaggagtagccgggggatgcacacacgcatgcacacacacacacacacacgcacacatgcacatgcacacgcacacgcatacacacacacacatgcacacatacatgcacacacatccacgcacaaatgcacacacacacgcacctgcacacacacgtgggtttgcatgctgacttgacatccaatgctaacagttcaaccacatttatggtttcataaatacaatgaatcatgagtagacctctaggtcaatggttctcaaagtgcagtcttcagaccagcaccatcagccttctcctggaacttcttaggcaaattctgaggacccattccagactgagtcaaaaaccctggataggtcagttattccttactacctttgcaaaacaccattctgttttagctcatggtgatcaaataaagagcaggatgaatgccaagatagagtatatagaacacctgatatggtgttctttggatcatgaccacacatctgttcccagcaaaaaggaattgtgccaacaggatgcatcaatgcactcctaatcagtgtcacctgatcatccactaatagctcaggcaaacatcagcttttccatcagtacacaaatcagtcattattcttgcctctcatcttagtgacagtacttcattgccccagcctacttgtcaaatccattgtcctgttaattttctccacacactccagggagataacagaatctctgggtagcagaccccatctcatgcctctgatatttataattgtgctgccaacctcctcttccaactagaattcctccccatgtttaaatttccaatttaatttcaagattctttgagaagattcctccaagtcttccctgttctgaaccatgtataactcttctgcagctatcatttggttcatcatggttcccttcatgaaaatcattttatgcatgtaatatcttaactgcccaaatgttattgaaaaagttttgagaggaagaactacatctcacatgcctttgtatctttcagtgcctagccactgtctcaccacaagaagttatagtgttttctttgatgcctttaatgtagatgtagattttcgctacaacgattttgccaggatgtgtttaaagatattcacccttggtcccctttctgcagttccttggatcatgaaagatgtgtttggtttggttggcccttacagttcattttccttttgaatcccaatttaaaattttggatttttaaaaaatagaaataaaacttatggctttctttaaaataaaagaagacttagaccctaagtctgcatttttataggagttgatgaaagtttatgcccctttgaggagcatgtgaattccaggctgccatggttctcagcacttcctaatataccgtgtccaatatggagattgagttctggattattacctgcctgtagtactgattttcttagattggagaggattctccatcaggactgccaggtttctagcattggctttgcaacttactagctttatctaagcaaccttgtgcaagatatttaactttgggaacagtaatgatacctaactcataatgttgttatcatgagttaataaagtccttaaaaccaacctggcacttactgagtgcgcaagaggtatttgctgttgttgtcataattattgttagaaatagtagtaatagtaggaaattcaaatgtgggaagtaattctagttggaggggaaggttggcagttgtagtaatagtatttactaatgtttcaaggtagaaaaatgaaatatgaattaggaaagttacatgttccaagaaaaatgggacacatttattttcaaaaataaagaatgttcctgtattcaatgtgtaaatacagtgttttggtctcaaggagactataacttaagatgtcagctaatgtcactgattacctgcttgatttatgttgcttcattaaattcaagttagaaaagtgggttcattcttgatttcttttatccaaatcctactatcagttttatgtggttattgtttttttaaatcttttcaatatatatttttatattggaataatgttagatttacagaaaagtttcaatgatagtacagacggttcttatttaccccttacacaatttatctcttgttattaacattttacttttctgtggcacattagtcaaaactaagaaactggcattgatacacggctattaactcaactatagactttctttggatttcaccagttttcccatgaatattttctctctgttccagaccctaatgctgagttccccattgcatttgcgtgtcctatctttccagtctcctctggtctatgacagtttctcagtcttcccctgttttttttttttctgaccttgaatcatttatttatatcaacatttttatggattgaattgtattccccccaactcaaatttatatgttaaggccgggcctggtggctgatgcctgtaatcccagcactttgggaggccgaggctggtggactatttgaggtcaggagttcaagaccagcctgaccaacatggtgaaaccacatctgtactaaaaaagtaaaaaaattagccaggtggtagtggtgcatgcctgtaatcccagctgctcggaaggctgaggcaagagaatcacttgagcctgggagggggaggttgtggtgagctgagattgcaccactacactctagtctgggtgacagagtgagaccctgccaatttatatgttaaaattcccaatacctcagaatgtgactgtatttaaagattggtcctttaaagagataattaaattaaaatgaggtcatatgaatggaccctaattccatatgactggtgtccttataggaagagattaggacacagccatgcacagagaaaagaccatgaaagtatagagggagaggccaccatctataagccaagggcagaggccgcagatgaaaagagtcctgctgacaccttcatcttggacttctagtccctagaactgtgaggaggtaaattactgttgtttaagtctccaagtctgtggaatttattatggtagccttagaaactaattcaagtatggactcatataagtcatctttgaacttttcattacaatccaattctatgttgtttatatcgtggctcaaatgattccagctttgacgtggtctccctctcatgttggttcctctgtcctcttagcatgtacctacacttgtgatttttgggcacttttctgatactacaagatgttccaggtttgttttgttttttccttgccctggcgctaaaatcagttatttctccaaagagtgaggttccttttacttgtgaatggcattaaaaaaccaagacctatggtaccaggttttgatccctgacctgtggcaccactttcaacataccatggttctgtagcagtgctggctgggaggcttaattcttgcctgttaagcatggccttcagtttggaagcccagtcgctctccaaggtcctgattttgaaaggcttttctttattgtgtgccaggaaagacagaggagaaaatagacaagaacataacatttaagcacaggtacagtcattctctgttcttttcacatttatgatgctaataaaagaaggaagatatattacatgagttaaagaaatttagaaatgttagaatttaagaagtagtgcctgtctctttgcaaatccatttcttgaagaggacaagtgagcctctttaaggagaaaattcaataagatacgtggaaacagagcttacataacttcagattttcctaacatcgtgtcttagggatgacagttcaagagaaaatgtgctaaagctgtgacttgaagggtttatttagatatgtgcatttcctgacaggcgagattagtggattctggaaaaagcaataaaaaggtttacagaattttcttctaattctgctgataaacagatgcaaactggcttaaactctgctgggattaaaatatttccgattcagtatttcatcaggtataaatgtggtttttcatccacatttcatttatgaggcagatgaaacattgagatctttttgattctgtgcatgcatttgatagtacacctccttggataaccaatattatgatatgcaatactttttttctacatttctctaacatgctgatctgtggagataggtggaggaggtagtgcttgttataattaaataatcacacattagttttcactaaggatctttcatcgaaggatgttaagagcaaaatggattctgcattattgctgcagtagatttttaattttactgttaataagcattaaagtcccacagcatgcaatattttgtttcttcccttttaaagaattaaatttggtgttttcccttagagcttgattgatttgctagattaaaaagcatttaaaatcattgtttaacacatggaaaaacatattgattgttgcagttctttataaagaaaaaagtacagtttggttccctgaaaaatacatgaattcttttagctgactcttagaaattaagacacatgtatctacaagtaggtttgggccaagaatgttccctgccccaactccgtgaaaaatttccattacatcagatacttctaggattgtatattcccttggaagatcacaaaggacatccgtctccacctttgcttaaacctaagtgatctttataaagaaaagactctttaatgtttagtagagatgtcacagaagtagacatatattagcatctttaaatgtctgctcagatttttcgtaactctcattgcattcatcctcctcttcaattgttaaaaattatagtcaattttctaaatttcaagacaggatctcactcccattgcccaggctgaagtacagtgtcgtgatcatggcacttgacctcctgggttcaggtgaccctcccacctcaccctcccaagtagctgggaccacaggcatacaccaccatgcccagctaattttttatatttttagtagagaagggatctcactatgtggccaaggctggtctcaaactcctaggtttaagcagtctgcccttcttggcctctctaagtgcggagattacaggcatgagccacagtgcttggcctcaatttttatctccctagaatatttatgattctttctgaatatcagttgcaaacccaaatctatatgataactaatcttccagaaattctaccccacaagacagagtcaactgtatacatgaagacatttatgaactctgttttcttttaggctcaacgatacttcttggcatatttttaacttttgtttataggccgttattaattttgaagtacctggtattgcttgtgtggaaataaatctgcattcgagtaattttaactctatgatttgggcgctaataatacttattgcaagagcatcctgaagtagtctcgggctaggtaattcatctagttcatcctcttcgtttcaggaaagtggatttcctagcctattcaagcagctatcacaaaataccccaagcagggtgtggcttagaaacagcagaacttgacttctcaccattctggagaccgagaagtccaagatgaaaatgtatttggtgtctgctgaggggtcactctccaacttcaatagcacctccttgtcaagtcctcgaatagtggaaggggtgagagagctctgtggggtctcttttatcagggcactcatcccattcaggagggttctgccctcatgccctcatcacctcccaaaggccccacctcctaatcttgggggttaggattttgacacgtgggaaacaaaaacatttgcccatagcaggctgctgggacagaatacagttcaggggctgcaagtccaaagccaggtgccagcaaagtcaaagtccaaaggcaaatgaacccagcagggctaatctccagcaaagcttctctgcttggcttgcagaggccagcttctggctgggtcctcacctgtcctttctgaatgcacgcactcttttggggtctcttcctcttcttttaagaacagtgccctattggatcaggcctccccacctcatttaaccttaattgccttcttagaggccccatctctaatgcaatcacaatggcagtgggggctagtgcttcagcatatgaattttggagacacaattctgtccataactgtaggtttttggttatctctggaaatggaaatgctttactttctaatttcccacaatccagagaagcaatatctttttttttcaactttagaaatcttttgaagttttgcattgttatacagcacttattcaatgccgcccaatccgagtgacttcatctcactcgacgacctcacctgactattccctggcctctgccctgcccagggcacacactgtggcaggtgagtgcttgtgcatgggcacacaaggcagatgcctgggtgttctgggcgtgctttttgcctgagatgttccatgacctggtctggtgtctcacaaagcctcctcatgagaaacacctttcttagggaaataccttgtgttgctcttttagaagattccacatgtggtccaagaggcatcagcatcccctgggagttcatgagaaatgcagctcagacccccatcccagccctcctgagggagaacctgcacttcttgagattcccccactgacctccaggcttaggaaagtgagagacacgctgccctaaagtggtcctcggtatagattcaaggcagctgcccaccccagtcatccaattccttgggctatcttaaattcttttccagtctcttctacttagtttaaataaatcaagtcacactttttctccagggactcatttccctcaaacactatatctgatgtttctgcacctactgggtttttatgcagttatgcagagatcacaggctgtttctatggatctttgcatattgcaggaatctttttgatagtgaggtaatttgtgctgaatcaaaaggctgacatgcaaagagagtatggtggcgtgtactaaaggctttatggtaatttttgttccatttcaccatcttttattcatatgccattttgatttttctagagcgaatatataggatattatctgaatccattttctcaaagctacgttttaacaacatttagtttgggacatttatttcgtattgaacacacaaaatgtttgctaaataaaggcttcaaatagcaacccctcccctgtttggtattttttcattgtttatcattggacttttagaagtgtaaataagatgtgtgagtcaaattctttctttgtaactgcttgaaaaattcagtaaccaattatttataataattggaaattaaatgagaatcaaaattcccagtgagtatatggcaagtttgttatttcctttctaccaataatgaatgataatgagtcaaataaaagcaatttgctttttcatgaaaagtagtgatgattattttaacaatcacaaaatgctttcctgaacatgttcttttatcatttctgtagtattgaactttaaaaaaagatatcattgagaataagtgaagcatggaacctgtaaattgcctgtttttgaagccatcgtgtccatcatttttagtgagagaataatgttctgatatctccacttgacatcttagactctattgtgttataacttcccacaacttgccaaagggccattctaaacttttgctcttcaatcggccatcattacgggaatattggcttccaatttttgtgtactaatatgaatttggctcatgaatgttactactccgaccaacaaaattcaaatgctccacaaaaagagaagagcctgtctagcacaaagatcttttcagcttttgagtttcctcttccctatcaatcatggggtttaatttaaattaaaaaggaaacattctttcaagatacatagtgtgaatcaatcaatcaatcgtacagtcttcctttacctaaattaatcacctttataatccttttagtggttcttgatctcttataggatacaatcaaaattccccatcttgatatctaaagcttcttaagctgaatcccatctcccttatcacttctttttatcatctctctctctactttcctttacacatattctattccaaataacctacatgttataccccaagccttactcagtcattcctcagagctgcgtttttatctgtggttacaaaacagatctgctgtcagaccagtcctgacttgacctttctgtgaggttgccatcaggtgtcggctggggctgtgtcttctgaaggatagggctggatagggctggaggagcctccacctaactgtcccccttgtgtggctgtcaagttagtgctggccccacacaggttgccgaagggtgctcacggcatggtgcctggtgtcttccatagagatacacgagtccaaatctgaagctctggtggctttggtaatccagcctctgaagtcacacactgtcacttccagtatgttctgcaggccacttgtagccagccctgatggagtttggaagggagtgagtagcaagaggcctgggtcccaagggtcatcttgaaggctggccactgcagggcctttgtccataccaacaaagctcaccctggcccatctctgcatgcttccttccacaccctgatagatccttcttcctctaggagccttcctgacccactctagattgaagcaactcaccacacacctgaaaccctttagcacatactatctagaccaagcaggtggtacatgttatattcacatgtagaagactcatccctggttgagtgacactctagataaatcactcaaggttccagctcttaaaagattaccttccatatggtggtatgaacagagattccctaatgaccactactcagaattaagaaggtaaaatatgccgcatataatatattcaattccttcaacactgtgtggctttggctaaagttaacttgccttcctcaagcatgcttaaatttggtgtgagtagtaggtctgtggcaactttgcagagttttgtggagaatttcctattacaaattctctaggttgtgagctctgcggtacaagtggctatgtgagactaatgagacattaagatcctgtttaaaggtgcctgtgggtccctgagctatcttgggctcccttctgaataagcaaaagggattaacttgggctcagtatgatgtaggttaaattttgacccagcagttgaactcttttagaagaataaatctattgatagtagcgttgggcagtactctgtcatctagaatgccccattttctggccaggctggagaagtgcattttcagtactggaaagctgagtcattttccccgttacagattgagttggacacctcctttgaggcatccaaaaatgacagggatttcagatgaagcaaggctagaattgtactcgatggacttgaacttgaacctgcagcttctcaccctccctgctacaacccttgtgttggagttgcataacttctgggagaaccatgccagagagttatagtagtccccacttatcctcagtttcactttctgcagtctcaattacctgtggtcaactgagatccaaaagtattaaatagaaaattccagagataaacaattcataggttttaaattgcacactgttctgagtagcattatgaaatctcacaccgtcctgctccatcctgctccgtcctgttctgggacatgaatcagtcctgtgtccagcatctcaggctgtgtacaccaccctcccattagtcagcaacatcatcttctgacagccaaccatggacatcatcatgccgatgattcaggatcacccaagcagatgatcctgcttctaacctattgtcagaaggtcagtagtaagctaacacaacacgatgcctgtgtcattccccagacttcatctcatataggcattgtatcatctcagatcatcacaagaagaaaggtgagtacagtacaggaagatattttgtgacagtgagagagagagaaaccacagtcacataacttgcattgcagtacattgttatacatgttctattttattattaattctaaaaataaaatctcttactgtgcctcacttataaatgacactgtatcatagctatgtatgtataggaaaaacagcacatatcaggttcagtgacatctgcagtttcaggcatccactgggggcatccccttggcgtgtattctcccccaccaaggatcaggggagcaattgtaattctctgctaaattctagtctgtcaggatacttagtgtttacgaatttgaataaatatgagtaaaaacgaattatagaaatgcggttttcctgctttcaagtgcaaacattgacctcagtggacaactcaggaaacgtttctagatccagcttctaggaggcctgtggctagctggctccctctgtatgcaaaccattcacatgcaaaatctcttgagcaattcctgtctaaaaggggctcataggctccgtgaaatcatgtttacagtttcaccttgcttaccaaggcctttttggttctagacaaaaagtctattacaacccatgtcaagctgtgatattattcaaatcactggagtctgatttcaatgatcgttttctatgcacagcttcaggatactcagcctatcacccaggaggtgaatgaagcaagtctgaggtgtctgggctacttgactttcgggtgatctcagggaacatctccccaccaattactttcaagactgactcgctgacatggaaattccttatctggaatggtttctgtctgtggttgcaatgcttttccaattttcatctacatgaaactctcccagaaatcttaaaatgtagtttttgttgcagtaggtttggggtgatggccccccatgctgctagtccacgtaccaagcactggaggtatttaaatgcacaagcccctagaaaaataatgcctgagactttctaaacggaagtcctatctgtagctcaggccattcccgtaagccccagcctgtgaaggctccctaggcacctgaggtgggctaggccctgacctgatttcatgacttctcccttgggtttttccctccccacctcccaccccgctcccagaagcgaagagatggcttcaccttctttactccctgccttgggcagtggctccaacatcttcacactctctcaagtcggacagttcattcatcttatttcctcactcccaccacaagtcagttactctgtcctttggatggtgatcatgtgcatgatggctgtgtcatgtttcccatctgcatttagtcctccccatcttcatggctactctgtgccagctactctgtgccaccctcatcgcctcttgcctaaactcttcaaaccagtgcaaaagcgacctcttatttgcttttgtaattcattcttcactgttttgccaaagggccattacaatacattgacagaatattattacccttcctcaaaatcatttgtgtctctccatggccaaaaccctttcacaagagatcactttgataaacaattaccacctgctcatagcctataatccaaccatactgggaaatgtatcctttagtagataggacctgcatttgcaggagtctttgtctcctaattttccttcagccagaaaccatctcctcctccagcatgccatagcagaacctaaaaagtctgcttcccttctaaacttctgtgtcaatttcactttctgcaggaagccaaccccaattccaccagccctgttccaaatcaggaaaacctgccccaccttgcctgccactagctctggctttggtagcatccttttgttctgttagtgttgttcacttaagttcttcttacaagattgtaaattttgaattacaaaaactttgttttattaatctttgtttctcctaagtcagccagcaaagaaccttgtttacagtaggtgcttaataaatatttaatccatttatcaattgaatgcaagcgtttcttgagtgttttttcttagattgtgcgaaaggaaagtgtgaaagatgaaaggaaatcccataatgaaataatgaaagagagtggacaggggacggctggaatagctgatgtcaaatgtacctgaaacacagctctatctgtgagtcctagagggtaggaaataacagtgacctcataagaaaccattcctctccctgctccctactttacaaccagattatattacttctgccctccttgggaaatgctatgttaaatgttatttttctgcaatttgtaatgacctttatatctgaaagacagttcctataaaaacatgagattgagaacccatcaaacaagtatctctaccatcaactaaaataagcaccatggacccttcttaagaagtgagggtctcatgtttcaggacaagcgtgttcaagtaccaccagccaggaaggccaaccagggcaaggctgtgcattccagaccctccagggctatggcgtcaggcacttgacctgtgttttaggcaattgtgagttaatggaaatgatattagcaatcataggcaatgactaatatttaccaagcatttagggaattggatcagtgactgctggaaatggaatacaagaattaatgttccaggaattaataatgatcctcagaaaagcttatggcttcatccacaggcttttgtcattttagtattaaaggcaaagcaatgaagagactgtggctcattcctctttccttgaatgggcgtttgcatgtttcaacacgctggaaggttaccttcttaaaatgccagctcattattcgtgtgaaagtgatcatacattggtattaaatgaagagtagaggcttatcattttagacatgatgggtatgctttatttacagatagtcatccttccaggagttaaattcacattgactattttttaaaatagtgctcacagcttagttctggatatgtttgcgttttccatctctcttggctgcttgagaacagagcgtccttaggaaaggacaagtcctgtgcagaatgcgttctcctttctcccacatttgcatttgcggggagaggcgtgcctgctgttgtgcacttcaccagcgacctcccacacccttggttctgccctgggcttgtcttcctttttctttccttctcttgaaggggttacagcccgaagcctgaaggaaaccagtctataaaactggtgaacgctgtctggatagagagaacagccctcgaattttgaagcgcagtttgtgtaagagtttatgggctctggatcatctgatagttctatttttagttttttgaggaacctctatactctttttctcataacagcagcaccgttttgaattcccaccagcagtgtgctccagggtgtttccaaaataagtgaaatcaggatgtcaaagagacaccagcacccccatgcccatctgcagcaccattcacggcagccgaggtgtggaaacaatgtaaacgtccattgaaatgtggaaacaatgtaaatgcctttgacggatggttgggtaaagaaaatgtgttatgtacatacaatggaatattattcagccttacaagagaaggagaaggccggcacggtggcttttgcctgtaatcccaacactttgggaggctgaggcaggcggaccacctgaggtcaggagtttgagactagcctggccaaaatggtgaaaccctgtctctactaaaagcacaaaaattagctgggcgtggtggcgggcacctgtaatcccagctactcgggatgctgaggcagagaattgcttgaacccaagaggcggaggttgtagtcagccgagatggagccactgcactccagcctgggcaacaacagctagaagagagaaggagatcctgccacttgtgacaacatggatgaatctggaaaatgtaatgctaagtcaaataagccagtcacggagggacaaataccgtgtgattccactcataggaggtatctaaagtagtcagactcatggaaggagagaatagaattgtggttgccaggcactgggaggagggaaatgaggagttattaatgaacaggtataaaatttcagcgatgggggtgggtagggcatgaggaaatacagtcaaaaaatgcaaagtttccatttgacaggaggaataagttttggagatctattgcacggcatggtaactatagttaataataatgtgtatttcaaaattgctaaaagagtagattttaaatgttctcacaacaaaaaataagtatgagatgatgaatatgttaatcagcttggtttaatcattccacaatgtatacatccatcaaaacattccactgtagcccgtaagcatattcatttactatttgtcaattttttttccaaaaaatcattatgcaaaatgagtaagttctacaaatctgctctacaacattgtgcctatagataacaatgctggcattttgcacttaaatctgttaagagagatgatcttatatgaagtgttcttaccacaataaaactttaaaaaataaaaataataaaataaggcaaagtttaaaaaaaaatgttcgtgagctctggaactaagcataccaggattcgaagtctgagtctcccaattactaagtgtgtgactttgggcacccacgtcacgtctgacactcagttctacatctgtaagtgaatataacaatgcctaattttcagcatcattacaagaagtatagatcctgccgcagggtcttgcatggggcagtaaccagaaacttgtagctactgttgtgtgactgccatactgtctttggcccttgtaagctatgtgattttagacaaataatttgcatgtcagtttctttttttttttttttcctttttttgagatggggtgttgctcttcttacccaggctggaatgcaatggtacaatctcagctcactgcaacctccgcctcccaggttcaaccaattctcttgcatcatcctcctcagtagctgggattacaggcgtgcaccaccacgcccagctaactttttgtgtttttagtagagacagggtttcaccatgttggccaggctggtcttgaactcctgacctcaggtgatctgcccacctcggcctcccaaaacgctgggattacgggcatgagccactgcgcctggcctttgagtgtcagtttctatgccttagaaagaggggattggagactggatgatctatggggagggtggtctaagactttgatgtgtatgagttgtaaagtaacataatagatccaaatgacaccaaaagcttttgctgaacccagtcagttgagtcaaacaagtcattagtggagaacggaaccagctatttaaattaaacactggcatgtgcctggtttattacagtggccccagtgcccagcatgttgtaggcactcaggagacatttatttaatgattgaaaagcatcagtcagagctacaggacatagaaagcacatttgaaacagttgagaagatgtaatgaagtaacaacttagtaaagaatggacagggtcaggaaagcaggaaaacgtggtgaaacattctgggattagaatcgcaagaagttgctaccaccctttggcccaagggagcagttagtgaaactcagcaaatgtctgtagttacagagaaagaggaaggacaggatctgtgggaataaatacctgaattctctcctgactttttgatctcttggtcaagcctcaaatctattggccaaacctaactaaaagctggagcacaaggaaatcaggttgaggctggtctgcagaggtcactcttcctagacaaagagcagatggaaaagggagcaaaaaggatctgcagggacaagtgaagaacatacagcactctaaagaagcttcccatagaagcaaatttgtgtatgtgggtgggaactaggatattttatttgtttggggatgcttttattacaggtaaaagcaataactgcatattttggtctgagatgtattttttctactaataaaattaataggctaataagggcaatgatcaccttcaaaaaacacacaattttcgctagttaatgccaggtctgatcagcacattttagatggatggatggttgaatgggtcaatgggtagatggatggttggatggatggatggatgaggaggaggtggtagatggataggtgaatgggtaggtggatgggtgggtggatgggtggatggatggatggtgagtgggtgggtagatggatgggtgagtggatgaaaggttgagtggatgggtgggtgggaggtgggtggcttggctaagttaggattgctacctttaaaagcatagcaatggtaacatagagtatcggccaggcaacaacatttagccagaaaagacagatccagagcagggtctcccagctggcttgcaataaataaattactttttcgtaattttgtcaaaaacgttcaatgtgcttggttttaatgaccaggaaatatctagctgtgttgaagccccccatctcagggggaggtattacctgctgatggttctcggcttgttgaaagttcacatcctaagagtgtgtgttgttgttagtgtgattacagaaaatctgcgccctctttctaacctgtgtcaaagataaacaaggcatgacacaaggtggtaagaacagattttaatcagcaacaactattgcaatagggaaaagaatacaacgtgaactaaattcaacttccatttgtacagcagtgactgggcatttataaaaggagaaggaaggagtggagagagttaagcaggatttagtagagtcagggaggtgaaaaactccgagggttagtcatgtgataatgtcggtggtgtctgcgaactggcaattatggaagttaggattccatcctcccacagagaccagacacagaggctctgtcctcaggtgtcagctggaacaagtcataagctcttttggcaggtgtgacttttctctggcaggcacttctggttgggggacagccagggccatcctaggaatgtgaccttgttctgttagaaactgtgctagtgtttgttcaagtctttatagaccgagcttaaggcctagttaaaaaaggattcagagaaatctgactcaagtttggtcaaagagagagtccttgccaattgttattctttaggcatttagatatctctgaatacccaaacagagaatacagacaaaaaggaataagcaaactatgttgtcaaggaacagttttattgtcaaaatgtatctcagtgatgattaatgaattggaaagttataagatgcctctattaatcacttttctaaatgagttgagttttgcagcacagctgaaaattttgatttcattgtttaaagcaaattttggaaagaactattgagtgcaagttaaagccggaaactcacagaggcaaagaaacatagaggatggtctgttcccctactgccatagactctataaagagcttgtttcacggcctttgttttcaatgttcctcctatggaaaaaataattgccagttttcccaccaatgtggacacatatatgaaaattttttgactcttcccaatcatttgtaaaaatgatactatcctctcctgtttttgcacgccattagagagatgaggtgcaagtgtaccataggcctagaaaccttgcaatgtcagctacgcactgtttatctcaactcacatacgcagatatttgttgcagattagggtgttgtctgtaaagaaagaaaagtgttcaaagaaaacctgctaggtgatgtatttgttttcgcttattgctgttacaaattaccacaaacttagtgacttaaaacaacataaatttattatcatatgagatccaaagtctgaaatgggcttcaagtagctcaaatcaaagtgtctgcagggctaattccttctggaggctccagcagggaatctgtttcctgcttctagaggcttctacatgtcttggctcacggctctttcctccgccttcagagccagcaatcgctgcctgtgtttttctaatatcatattacttgacaccgactcttctccctccctcttccacatttaagtacccttataattaaaattgagcccacgtggataattcaggataatctcctgttttcaagccaaccaattaggaatactaactccatctgctgcccagttcacgtaacgtagccacaggttctgggaattaggatttagatgtctttgggcggccttgttcattacaatgaagcaatttccatctgctgcagattctagatctagaagttgccacttgacaactgcgtgactttaggtaaatctcctgacacttaaatgcttccctggctcttctcatttgcaagttgaaggcactgtgttaggtaacctctgccatctctttcagagccctccaagtttgaggaatccttttgatcaaaggtgaaggtcatgaagtgtaatttgctttgccgtggttattgcattctcgttgattgattttttggattggatacccatgaagtcttatgcacatttaaagttaattatttcttcattatataattaaatgtagatgagtcccagtgtaaagtgtcagacggataacttattctttccaaaagaagaacagactcactcagcagcagcttttctgctctctctggaaaggaggtattgagtcgtcttagattaactcatggtcttcctgacaggattgggtatggattttaacagattacagtcatcttggatgccttccagaaactgattctaaactgcttttatttttcataggaaacacccaacaacactgcatagaaattagatactcctaaagtggatttgaaccagtaaaattagctgtaaatatcgaagcataactaaggtttagtgtcttctctttgtaggtaatttgtgcagccctaacatttctcccctctggagcttagctgtacaattctaatcactactgtggtctctgctcagtgggccatcgctcatgttttgaaagcactggctttgtccctatgtgagcttgctagttagttgatacatgcaggagtgtggtggcctcaggggaatggaatttctttcttctgtttataggttagtttggggaaaaaaatgtgtgtgtgtgtgtgggtgtgtgtgtgtgtgtgtgtgtgtgtgtgtgtgtttactgagatggagtctcattctgaatcctaggctggagtgcagtggcatgatcatagctcactgcagccttgaccttctgggctcaagcaatcctcccacctcagcctcccaagtagctgggcctacaggcacacaccactatgcctggctaatttttaaatgttttgtagagatggggtctctctatgttgcccaggctgattttgaactcttggtctcaagtgatcctcccacctcaatctcccaaagtcctggaattacaggtgtgagccactgtgcctagccaaaaatattgtgcatatttttaagcactggttggcattaagtttgagggttacagggctaaaacaaaagatgagattttactacaaaaagaacttggaggctcttttagaattggattcaactttcttcctgctatagagactatagattgcttgatttatgatgcgagatttgattcttcatgtcatcttgccaacacagccgctgcagttgtcttgttactccagctctttacccagcatactgtttgccagttgaatgttattcaagccagaagtttggcaaaacactttggtacaataaaaatatatttaagaatttaacattttggctttttattgtagtattgagtagggaatgggaaattagccaatgataggactactagggtctacattcgaaagaacttttatagcacaatcttttggtaacttatttggttgaggacgtactaaatacaaataatcatgtgggaatttggtgagctatggtaatgaatatgacgtgagatgacttcagaggagtttgcagttccgtagtagagacagacacgtgtagaaaatcctgtattggtcttcttccttgttgaccgtagtgctttcagtggggtgcatctcattagaacgttgtgattgggacatacaagtggaaggtttctttaatgtctggttcccatatcggtgagacatagccttaatgtattattctccagaggggcaaaccatccaagactattttagaattaaggacttgctgctctggttacttggtcactgttgagaggatgtgttggaatgacatagcaaaccatgagatgatggttttggaaaaacatcagccgagtaagttatttggtactctgccttaaaaaaaaaaaaaaaaaaaaaaactgagccataaatattcaaaaaagtttgtatgcacagaacacaaaattccaagagaattatttgtttcctaccctaggagtcaaaagtgtttgtttagaataatgtgtaagagtttcttaccccgcccccaggattaccaattcctttaacaatgccctttatttgtgcatcagtgctagtaggtttttcttttaatcagaaataattttggtgagcgtgtctatgcacacagaaatagctactaagatcattaatattttattgttgaaagcagttttatcttataatcacattttcatttgatgtttttagttttctgcttctctcacataaatgcatggtgtcgagagaggcacaagtatttttgtctctaatatcttaaaaattaggattaagtgcattctgtattgttttgtattcacaaaatagttttgaaaaagcttgagattaagtgaaatttgtatgtttttaaccatagtttttgtgggacaaatttacgctttatctctttggtttagatgtggttgacatattgatgcatgtattctctttattctgtaggctttctttttccttagaaatgaagtcacattcagtagttaaataatactttactcaaaagtacagtgatttgaaaataaccttcaactgtcagaagaggctgaacttgactgaaatgtggcctcctaactgaatattgcacatgaatcttaacagaagttatcataaacatttaaatatttgcacttggtatttagacattgattttcaccaataactgaatagatataaagcctatttttcttctttagccctcatgaatatcaattcagtttgttttttgtttcttctgggtgattcatagatgaatgcctagtgtcttcatttgcaagctgttcatggaaggaagccacttttctgttgcctctgtaaccattgcagggccttcaatagcagccttcagacactaggcatgcattcagcattggaataaataggatagccaagggtagctaattattttcaggttaattcctaaagagttaatttgcactgccttgcccaaaatcaaaccagcagaacattttattaagcaaggcttttgtgtgagtggtatggaagcactgaatcagttgctgtttcttttaatctaaattatcgtcattttgagctttatattaatacactggctgagtaactttgtttaaaagaaacctaggtaaattgatagttctatgttctaaattcttctgaataagaaaacagtgatctgccagatgaaaaaggcaattcagaatgtgacataacttctgttgagagatttttgttgaaaattgggaagtatgaattcttcacagactttcataaaatatttcaatactcttatttttaaaaaaccttgaaaagtcagaaatcagttagaataattgacttctaggcatagaaaaattcatttaaattttatttatcctggatgtcttcttttttagcataatacacctaaaacagatattccactaatatagagtgattgaagtattcagaggaagattgcattttaaagctataaagaacatttaagagtaaatgtggaaaacagtatgcagatttcttaaaagaactaaaaggatacctgccattcaatccagcaaccccactatttggtatctacccaaaggaagagaagtcgttatatcaaaaacacacctgcacgcataggcttactgcaaaaaaaattcacaactgcaaagatatggaatcgacctaagtgtccatcaaccaatgagtggataaggaagatgtggtatatatgcaccatggaatactactcagccataaaaataacgaaataatgtcttttgcagcaacttggatggagctggaggccattgtcctaagtgatataactcaggaatggaaaacctaatattgttatgttctcacttacaagtggcagctaagctatgggtatgcaaggcatacagagtggtataatagatttggagactcgcaagtggggagagcggaaggggtatgagggataaaaagacacatattgggtacaacgtacagtgttaagatgatgggtgcactaaacgctcagacttcagcactgtacgcttcatccacgtaaccaaaaaccacttgtacctcaaaagctattaaaataaaataaaacataaaacaaaataaagagaatatatagcctacttccttaggttttatagtcaaagcaccactgatttagaatctaaaggcctggcctcaggtctgattctgctactttacatctgtgtgaccttgggcaagtctcttaacctctctgagcttctgcttcttaatctgttaaaaaaaaaaaaagcataatttgtcttatccttgttttgatcaaatgaatgagttctgggaaatccatccagctggtcagtggaatccacgtgcgagcacagcaaggcctaacgaatttgctgacgctcctctgaccacctagcttcacagatgggtgggcagccagacctacaacccaacccacgtctgccaagtcccagcctttccattcacctttcaagggaagaaaacttctcatgtattggaaagcacagtgcctctagtgcctctctttcttgattgttggagttgggtctctcagcattgtggttcactacgacagagcatcgcttttaacagccacataaaataaccctcttgggtaacacactcaagaggcttcgtgaactcgggaggcaatctgggcaggcttacagctgtgtgacaacacaaacgctgtttatttgagtgttatcaggaagatgtgtcactgtcatggttgaatatggagaaacaggtgcccgcctcggaatggctacccaagtcaaggaggacccaaggctaatgtggagaccacgttcctccctggagtaccggggttaggcagggcttgaatgaggtgcagcgaggccggtgaaacacagcagtaccacgtgtcttatgtcacatcagcaatgcaggtcgcgctcgtcacagacatttcagatggagctgggtattatattccagtcctggcatttattatggtcaccaccagcacagagcgttcctggcctggtgctgtctggtttctggaatacaggccatccttcctgatattctaaagcctgcctcccaccctcaaagagtcagacggcaagtttccatccaccctcccagttctcagcctttgaaggtgagaagctcctcttctaggggccgctgtcagaatctcagggtttggcactgttgcgctcgcctccattccccaggctcctcgacggccttagatgcttaaacacgctgctgcctctcatctctggaccaaggctttcgtttccctgtgagtagacagcactaaggcacggggttagtttaatgatgcaagtcaactggggagccttgctgctatagagataccctttgtatgtttactttaacttcttgcatcagtcaattcaggctgttgtagcagaataccacagactgcacagcttaagcagcagcaatgtattccttatgattctggaggctggggaatctgaagtcagtgtgctggcgtggtcaggtctggtttgtagatggctattttcttgtatcctcacatggcagagagcacagagcaggctcttgagtctccttagaagggcactaagcccattcaccctcatgacctaattacctcctgaaggcccccctcctagtgctgtcacattggggagttaggatttcattgtatgaatctggggagacacaaacattcagcccatagcacttccccagccgtgcaacacaggtgccctttggtggtgtttgcataggtcatggctgctgatagccaccgtgtgttgactgcccactctgtgcttgacgctctgctagaggctctttatgttgtctttaatcctcacttcagtgctgcaagggctgtgttattcccagctgacatatgagcttccaggagtttaatggatggaagctcagctggcacatggtggaggcaaacccagggatgtctgactcattcgaatgtttctttcgttaagttaagtcttccattcaggaaaccaatattgcaagttcaacgtgtgaaaatgtcactaggctccacggtgctagagaggtggatcctgatgatgtcctgtgctcacggcgcttactttgattggcacccagagagaagacatgagcaacactggttgtgttcagatgagagacagtgcacctcaagggaagtgttggtgaagtcctcagaggaaggaggaacgcaaaggcctgtgttcagaacaccgtggtgccctgagaacagctgccaaggatgctcgctgggagccacaggccaccagggggaagcgccaaggccgtctttcaagatgcagttacatcatcactgagcagcaccagctcagggctgctccagcaagcctagacccaccctgcttccctgcgccactccccagggcctgctccacaccacccacaaaaggcaggcggacagtggaagaacactccaggcccccagctccaaaggctcagatagccgctgtcgtcaaaacctcatgtcaggctctgtttttctttcctttcttttcttttcttttcttttcttttcttttcttttcttttcttttcttttcttttcttttctttcttttattatttctttctttctttctttttttttttttttttgagatggaatcttgctcttgttgcccaggctggagtacagtggcatgatctcagttcaccacaacctctacctcccaagctcaagcaattttcctgcctcagcttcccgagtagctgggatgacaggtgcatgccaccacgcctggctaatttttgtatttttagtagagacagggtttctccatgttggtcaggctggtctcaaactcctgacctcgtgatccgcccacctcagcctcccaaagtgctgggattacaggcgagagccaccgcacccagcctttccttctccctttcttacccgacttccttggaattggtattcaggaccttccttttctcctggtatctgcccagtgatccaggacagcgctcagctcctggtagccctgggctctgtggtttcaggctgggtgcatctgttcctgtgccctgatctcagcctggcccagctccttggcctctccaccctccacttcccttggaagaaaaaatgggggtaacggtaaggaggtgctctgagtaaagcagtttccgggtccaaaataattcaaagaaatgaagagcaaaaatcacagtacaagtagtttagcttttcctcagttaatctgccataatattaagtaaagctagttttaagtatttaggctctaatgaattccatgtactaagttgcctggctgttttctaatacatgttatttgaagattctcttgaaaattgcttatatcatgctgctatgttacaagaacatggttttcacgcattctggtatggaatgtgtatgttgctgtcacttatttaataataatagtcacaattaatcagtacaaatatttatggccctaagtaccctgagatctgttgcttgatacatgtctgaacattttggacaaaaagaggccagtgtgggacaatgagatagccttttaatagagagattcttttctcttaacaatgatctaggggttttcggggggaaacacacacccccttctccatcgggaccgaaactgctcttgtccgtgtgttctgtcacacgtagatgaacaggctttcaacacctgcactggattttataatgcattgggtttggttattgtcattattgtttttaccagtttatttattcattatggtgctagccacaaagcttatgcatgctgagcgtgggtttcaaattttgagtttttttgaaacattcaagacacggaagtgggcatcacaggtcatgagttctgttcgataatgatgtcactggtcacccatgttgcttttgacttggtaaaagaaaaattgtacttaggaaaagctgccctcatataatgtgtactcatatggtagttaaataagtccagtcaagggctgtaagacagccaatcagaatcttgtttctaaatgggcatgtttctaaactggtctatgatgtgctaatggacagaattttgcatttggaaaattgccatcacaaactcttgagccttccattcttaaaccagttgcaaggggctttaccaaactgacttatccaggttacagatataacaagttcctgtaggtaatggctctcatactagactgcaagtttttttttttttttttttttttttttgagacagagtctcactctgttgcccaggctggagtgcagtggcacaatctcagcccactgcaacctctgcctcccaggttcaagcaattctcctgtctcagcctcccaagtagctgagacagggactacaggtgcatgccaccgtgcctgactaatttttgcattttttttgtttttgtttttttagtagagatggggtttcaacctattggccaggctggtcttgaactcctgacctcaggtgatccggccgcctcagcctcccgaagtgctgtgattacaggcatgagccccctcgcccggcctcatacttcattgtttataagcgtgtactgggcacattgtgaaacacaaacgttctcccaccctgtccccagagactccagttcagagggtccaggaatctgcatttgacgtgcacacccgggggttctaaggctatttttgtaccatcattttgagaaatacatgaagctatttcaaacactcctcataatgtcaattagtcttctccttctgtcctaggaactagataattattatttcttttgtccaaaatcctttggattatacaaatgcattatatctggaggcagtaattaagctctggcctggcccacttttctccagataagtacactgattaccttcgcgtttccttacaggtccaactttccaacaaaatcatcactgtttgctttcctttaggcctacacgttcttttcctctgttacacaatgtctgaagtaaaacaaagatttctgtctttcctttcatgttgtacatgttgtgactaaaacacatgcctcaggtctcagtctatcttaaactgtggttatttctttaaaatccattttacctataagaacaataaaggcgtcttcaggctttttaaacctgtaacaatttaaagacattgggtcataaaataatgtttaacctggactgatacaattaaaataaaacattaacagtctgaattttgtttaagatagaaacttagccctcttgttcctggtatgtgcgacttcatgaaaacccaagtttcgctacttaaagtgcagactatgtttctatagtttcaggtagaaattatttggaaatgtaccatgctgctgtaaaacaaacaaaaagccaccctaagcccgtattttctccttttgtgacactgcagagttatagtttccacacagatatcgtgcctgcagggcctttagaagcatgtggctgctggctttcaccctgaaggtccagactgctggactcttcagccgccgcttcacccttccctctctgcttgctgctggctttggggttgggatctgcttcccactctcctgcatctgacgtgctcttccatttttctcccagtccatcatggtaaattcttgtcttcatattccttctcttctcccacctttgtttctgagctgctcacctgagctgtgggagtgcaactgggatcatcagcattttccaatcaaagtgctcttatcttctgatcagcaaaataacccatcacagaaatgactgaattaatgactctctagacagttgagtctcttccacgtttttgatcagggcctgctcatactcagacatttcttgtttgttgttgttgcttttatgttcatggctgttcccaagcagagagaatttattttattctatttttatttttattttttgagatggagtctcgctctggtcacccaggctaaagtgcagtggtgcaatctcggctcactgcaacctctgcctcccaggttctcaagcaattctcctgcctcagcctcccaagtagctgggattacaggcacacgcccttatgccccattactttttgtatttttagtagagatagtgtttcaccatgttggccaggctggtgttgaactcctgacctcaggtgatccacctgtctcagcctcccaaagtgctggaattacaggcatgagccaccattcctggctgagaatttcatttaaattgtggattactaggcattaattatgtttgtgtgagagagagtggcagagggacattgaaagagcaacagggacagagagacagagagagaacaaggagaaggaggacgagagagaaagaaagagggaggaatgggagggggtactgagagatcacaccaaattcattgcacgttcctgtgagttgctgccacacgctgcactgggccaacgctttcccaccagtttcactagtggagatgacctcatcggatcctctttgccatcttctgtgaggttggaaccatgcagagtcctgcattttcctccatctacccctaagtccttgtgttaattatgatctgtgttggcttttatcacctttgtggaaagagaagagccaccaataatgaagactgagtaaatgagccagtgaaacagagacggggatgtgcaccccccaggctcctggatgattattgacggacacgtgtcagctgctaaatgttatttaaaacttgttcttgccatcctatcatcatttgctgtcctcctgaatatggaaatacaatgattagaaggctgttttaccatcctgagatatgtgcaccattgattttgtaatttgttgctaccttctacttatagtaaatggtccatgatacataaaagaaatttatgtcagagcttttcacagtgaataaatattaggaagaaaatacatttagacaatagaaggaagcagtgtaatgggagatcctgcagtcatgtatgtgtcgtttattttctcccaatattttttatagtagctgtgtgaatatcttactttttacggtgctcaattccacattggcctgatatttgacatattttaaggcacagtgggagaaggaaccaatcctgacctttctctaggcacttttctgatgtcagtagatgaactgaataattaatatctgacttcttctggaacttatttgaggtggcttacagaatcctcccctggcttcctattgtgttttggataaaaggcaagaccagtggcacggtccacgaggctgggcctggttttctttgtgcctgtctgtccagcttcatctcggatgcttcacgcctcactcctgacatgtagccacacatgcaccaggttacaaccgctccattgcatgggaaacctgccccagctggtcaccacctccttcctgtatactcttcaactctcagctcaaattctcttcctcagagcacccttgcttgccccaacacctcagtaaaaatcagcacatgccccatcattatacgccctcttgacacatggaattcctgcccactgccccacctcacagtgtcactgggtttgcctgaggtctctcccaccgcgtgcaagtgtagggatgtctcttcagttcagcacgttaggccaatgctcactgtcacaacattggtatccagtacacgtggttaaccattgctattgtgaaatattataatgcaaaaactatggaacatgtaaactcacagcttaatgggtgagtgtaacctgaatttcctaatgtgaaatagcccattcaggtctagaaacagaggacagccagtaccccgcagctcctgtaccttgacttcctctttccagtggcaacttctctctccccgttgagttatgcagcatcctggatttcatggaaatgtctttctggcttgtcttcatgaacttacgtgtgaaccactcacttagtgtagtttgcccactgtggaactttttacaaaaagaaatattcatcttatattctttactgtctgatctatgtcacttaaaattatatttgtgaggttcattcatgctgtgcatgtagtcagaggttgtgatttgcatggctatatggcattctgttacatggaatacaccactctggtagacagaccaatgacaccccatgaagatgtccgtatcccattccctggtacctgtgactatgttagcttccctgacaaaggagactaaggttacaggtgaataaagatagtaagattactcatcaattgcctctctgcagccaatcatttctctgatgctatttgtttttccattatactggattatgtgaaaattctgatactaggctaatagctgtttaacatggatctaatgaatagattccattctaggccagctatagtttaaaaatactacagctttctttttgagtaatttgatacctaaaatagtgaagacctcaggaagagcccatcctctttgagacccgtgaacattctgccgtgccaactgtcttggctggcatttgcttccccttaaattagcttcctcctgtcacagaggggcccatactacaaggctggtggatgatgacaaatttgattcttgaaaatctgttaaggtaattgcaaaattccactcagtttccctgggaaaataactctacctgctagtagaatcaccagccttttcaaagaaaatgtatacatcaaattagcaaattagttattttaaaattgtaaaccaaaggccaggtgtggtggttcatgcctgtaattccagcactttgagaggctgaggtgggcggatcccttgagtccaggagttcaagatcagcctggccaacatggcgaaacccagtctctgctaaaaatacaaaaattagctggacacggtggtggacgcctgtaatccgtgttacttgggaggctgaggcagggagaaatgtttgaacccaggaggcagagattgtagtgagccaagatcacgccactgcactccagcctggatgacagtgagactccatctgaaaaaataacataaaaataaaataaaactaaattaaattgtaaaccaagagtgttgttggaatttccacctagtcttcgagtgtaagtgtagctagaatatgccgcagacacaggagcatacccctcaggaaccagggagcaggcgctggatgaagcatcaatgcttgctgtacattcggcttttgtttttgagtttcagaaacccactcaaattagtttaagtaaaatggaaaatgaaatatctcctaaaggctgggcactgtggcaaatgcctgtaatcccagaactttgggaggccaaggagggtggatcacaaggtcaggagatcgagaccatcctggctgacacggtgaaaccccgtctcgactaaaaaaatacaaaaaaattagccgggcgtggtggcgggagcctgtagtcccagctactcaggaggctgagtcaggagaacggcgtgaacccaggaggcggagcttgcagtgagtcgagatagcaccactgcactccagcctgggtgacagagtgagactccaactcaaaaaaaaaaaaaaaaaaaaaaaaaaaagaaaagaaaaaaagaaatatctcctaaagtaacaggagtgcattattaaatccaagggaaaaatgcatccaggcctcaggaggaaaagtacatcaaaaatggaaagccaagaggagctcattctgtctctttgagcttcttacctttttgcctttgtctctttgcttttcattctctttggttctgaacctctctacttcattcctctcattctgtaaatctgctttatttcctttggaatctttacaccatatggcagcaggcacttaacttccctccccaccttccgttctcatggtttgtgacagcagccaagaacgacttggaatattttaatctcacaccacaaatcctggagcagacttttgacctaggttaggccaattaattgtctctggctgaggaggagaggagggggctcacagactagaaatgtggcttccagggcccatgggtggaggaggagggcagctccgatcattctgactgggatgctcttcacaatgcctctgtaccgtgctggaacattgtaccagggtggcaagccctttttaaaaagtgagctccaattactttagtctctgccattcaattgctggtggttcttgcctttgaggctagtttgttagttacttaatatttattgagtgcctgcagggatttttgacattgagaagtgatgtgttgagcgtgccaaaaatctacccagtatagaaaactcatctcaaaatcgcctgtgggtttcagagagtctatgcaaaaacagccattatctaaacatgctttaagacgctgttatcatacacagcaaggtgaaagatacaaatgctcaattttaaattctgcagcttacttcatagccatcttttcactgaaagggatttctcttgggcctgatgtgttgtgacatttttttctgtggatgatcaggtcacagtgctgctgcttttggaaatatatagaacaacttgatacctttaaaacattatatcaaaatagaaccaaagtagactgagcccagaaagcaagactaacttacattttgaactaatttcataaaagaatctatcagacccagtcaattaaactgaagagcctaaaataatttgaacctgatgttggaatttgcaggtaaaaataatcaagaagaaatgttaacagatagctattgcatcaataatttgcctgtttgttttctagaaggattgatagggcagaagttaattctgaaaacacagttttgctgaccttcaagtagagggctgacagctgctttagcaagggtggtgggtaggatttcaaactgctgtgccctcaggcagcaacatcaagtcatgttatgtaaaataggcaacttcagaagttcccaaatgtatttgagaaaagtagggtggatcccaggtgagtccatgaggcgcatacggaaagggtgtgggagagccctgggagagcctgagcagtgagacgtcccttctccacatggaggacgtggtggacactgcccaggggaagaggggcacccgcaggtttgtgtctggatgtaccggaaacattggctcctctgcttccactaagatgatgatgatgatgtataattaattgccagtcctcgaaagttgggcaggttaaccaaaattaacttctaattaatgaaataaacggaggtgttggggaaggtgggatgacatcgtcttccaccaccaccacatcccattcccgcattggttgcttcagtctttctgaaagggctgctcagctgcccacgcctgcagtctctgcagttattcacatggaggcggcattaattcataccttgcggccatatccattatccctccctcacccccactactagcaaaagcaccccggaagtactcacaagaaacaaagtgacagtcacaaggaaaggagcatctcggggagtgggaaagcttcccctgctaagtacatgcaatgctttattggacgatgagttagggtcctcttgctccaacaagactggcttgcgtttccacctccagccagcattgtgaatcccaagtagctgctgatttatatgtatcctctggaattatttaaagctatcaattacctaaccatgggtatagttatatcgtagaaaaggccactttccattttgggagcgagacattgtcttctagtcttaatatacttctgcaggctgcctgatagaagaagagattgattggtttaaagatagattgttatgagagaaataatttacttcacttcctccttccctagtgagaaggccatctggttgacccctctgcctttagctaagggacatagaatgcacaattgccagctgtccccaatgtggctggcaaggctggacctcagctgtccccggggtccctgctgtgctgcccccgattgctccagtcttctcctgcaggggtgtgtctttaggaggaggctttggttgatcgtgaaatcatcctccaatctcacttctgctggaggtgactccttctgtccctttagctgcgtaaggccagacttacattacatgaaacaaacacgtcatgggatgtgtacccggaacattcacagtggttattggctgcttgaggtatgcatcactttactgtggagtcacaattatggatccaataacctggatcactctgctttgaggacccaaaacaaattaaatttctgatttcccctcattaaagctcaggatgcaacaagaagttggaggatcacaagtggaatgtgaccactctagccccttccctttctttataaagagtaggaaatgcaatgcactttcgagttctttctctattacatatcatatgttgctaaaacattacttggtggtgatagcaataaatagtaaattagtatcttgtgtttctataatttttataaattatagtgtgctttcaaatacatttacatttaatcctgataacacctatgcaatcagttccttttgtgtcccactcctttcctccttgcagcgttcaaaaatcgtctccaacttagagttctcatttgaatcttctcctcttcataaggcacaaagtctgataaaggtagcaagcaaggcaaatccatgagagatacgaagctcaggccaagatgagacgtgtcagattttaacagagaggagagaacagggatgcataacctgacagagaggcgtgggctctatcagctgtagctggggagaaaattaaagcggcctgcattagggtcctccttgaatcagttcatagacattgtggtgtctacaattattatcttaatctgggtttcttgcactcgagatacaaaattggcacacacaaaagtcaagctgtaatcacaagttactaagataataacattggataaaggtgaattttatgtttaaaatgaccaaacgactcagaaaaggtatagcttggttttagttcgttgtttgttttatttttgcctgagttaaaaataagtatgagcagcagtgatgtcgcaaaggacaggattgccaactatgcgtgtcagtttgcattacatcttgcagaatccattgctgcttatggcctcattcacgcaactgggcttgcattaaccctttgctttctgcatccatcaatgattgcctttctgttacttctaaaggcatttatccatccattcatccactcaacacagtctctgtgcactatgttgtcccaagttttgtacgagacattgagacgttgaacacagtaaggtaactgtgtccttaagtagtttgcccccctggtaatgacacatgcattatgataatatattaatactcatactaagataatatatattaaagagataaattaatagtggaacagtgttacagaaaggcactcacagagtgttgtgattgtgtccagggggaaagaataatgccggtgaaaccaggcaagacttcctacgatgtcagaggtgatattttagctgataagtaaagaatgcaaagggatttgcctggcaaaatgaagatgaagggaaattccaggaaacagaaaagttgtagggcgtgttgaggaaaggggacatggaagggaatgacttgctccaggaacaatagggtatgagcggagtagggtagaacttagatttggcctagaggtagaaagaggacagacttgccatgtcacaggggcaaagggtgtttttttcttgaaaacagaaggctagagccccagagagggctttacatgcaaaagggatacataaatatatcccgacacctaggtctgtatgaccttctcagaataacactgttggctaatatctttctattgtatgcccagaattcagctacttcccagcatacccaccactgccacccaggacagacctccattacccctgtgccttgttggccgctcctgttcccaccctggtttctgcaagtgtttcctctaagcagctcccctggccaccttccttagtgggagccttatttacacactgctgtgctcacacccctttcactcagaggtaagccgaagcctgcacctggccctcaggctctgcactccctggccccttactgcccccactcctcagaacagtcaccttgctctcccactctggccactgcctccttgctgtctccactgaagcctatgctgtctcacaggccaggcacctgccactccctctgtctggattgtcttctcggatgtcagctctgcagattccttcagttctattcagatgtcactttgctagagatctctctgatgcaaacagctcccagagctccattgtcctgcttttctcttctcttagtgagctgatctgcttattgtttgtcccttcccccattcctgcactagattacaagaaaaaaaatgaaaaaaaaaatgaaagccattcaacttctgttgataacagtgtcagtatctgttttattcattcttgtattcaaggttctcaaaacctaacctggcatagtaagccctagataaacatgtgttggatggatggatgtggattgacagatacatggatggatggatggatggatggatggatggatgagtgaatggatggacggatgtggatgaatagatggatggatggatgagtggatggatgggtgaatggatggatggatatgtcgatgaatgtggatggatggatggatgtggatgaatagatggatggatggatgagtggatggatgggtgaatggatggatggatacgtcgacgaatgtggatggatggatggatgtggatcactgggtagaaaacttattcttcttagagcaaatggttaattgtgaacatgcttttccattttaatggatctccaaagtatgcatgtggtaacggaatagggaatatgttatagcctcactttcaccatgctaggcaaaaaatgtctcattctactgagaaatgcactactgacactcagtgtgccgggggacaacctagtgacttctcttgactttcatggaaagcagaatcaatcctactcgaattttcaacagttcaactcctgcaagttaggaggaagtctgaatgtggggagccaaattagatgttcaaagaagcacatattagcttgcattctaacttgaaaactgcatctatgctgtggttgtacccatttaaaaattaaatgtgcatatagaccagaaatagaaaacaatatgaaaaaggcttggccaggcgcggtggctcacgcctgtaatcccagcactttgggaggccgaggcgggcggatcgcaaggtcaggagattaagaccattctggctaacatggtgaaaccctgtctctactaaatagacaaaaaaaaaaaaaattagccaggtgtgattgtgggcgcctgtggtcccagctactctggaggctgaggcaggagaatggcgtgaacctgggaggcagagcttgcagtgagccgagatcgcaccactgtactccagcctgggctggaaaaaaataaaaataattaaaaatgaaatagaaacaatactcaaaagatatcaattatttgagctaatgaagataacattaattttatcattctggttcatgaataagatttggtcttgatgttctgtttttaatggtttccttggaatttcatcttaacagcgtttgaggaatgtcaactgggctgtgagaaattgcgtgcactaggttgcttgtatgaatagtaccactgaaagattcctgctagtcacagacttgatgaaaagggcttattttctttctgaattcaggtgaaatgaaaagctgctgaattagcaagatctaattacttatccttggccctggccagtgattttctcccaaagaaaatactacctaataggaaatgagattgaatcagtgtaactttctgtagctgttttgttgctcacggatagtcttactttttaagttctaaaaagctactctctgtagatgaattaagttatagatggcaaatatgaagacttgtagaaattctaaaccactgtagaactctttcctactaagcctataatggccccatgaatttttcttaatttaataacaaatatagccaatattaaatattttggatgatattgcatattgtctattttagtttgtagcaatttgacacattctaaagaacttttaatctttgatgaaaatatatttatgtattgcattgtctactttttaaggccgtcttcattctacctcattttggcttggttactaagttgcagttatgtgcactataagagtgtattctccagactatacatggacagaagtggtccctttgcagtgtgaccatctgtccttatttgttcctgtataattaataataatccatgtgtaactattatatttattacttattatcaagcattcatatgatcctttttgtctctcaaagaatcacagtttcgactaaaagttatatgattcctctaatttgcacggaactgaaaacttggtctcagcagccagtacgcgtgatgaatttcctagacttatgtagtctttagcaccctttagcagtgtctccagagtccctctctcacctgccactcttgctgcagtgcaagagggttctctggaagggactgaaacctagaataaggataggtgagttgcccagtgaagagagaccaggaaaatcttgaaaccttgaatgaggagctatggaaaaaagaaaagcctgaaggcagtgcgatgggcagaagttggtgaaaattggcacatagcatgtgctaaataaatatttaaatttggtaccctgaaatagaagttgatcacatggatgtaaaaaaaaaaaaagggaatgatgacagaggacttggagctgaaaagtttaatcctagttgggttggattcaatgagggtaaggaatttagctgtgaagaaggaaagctccaagatgaccctatactgcagagtctggtttattgggaggaggagcattaggtttgcacaaaagctgcaaacataataatatcagattctttcttgaggtaacatttggccatagtacaggaaaatgacagccgaaggctttgggccactgaaggcagaagggtgcagaagggtacaaaagggaactaatagtagcttcaagaatgggaagatgcctctttcactgttttgtatcttggttcttgatttaaatgaaatatgtctatttggcttattttatttccttatttcactcactggggttttctttgttgttgctgtttttaggagctggtggggagtaaccctccgcagaggaattggaaaggaatagcaattgcactgcttgtcattctggtcatctgctccttgatcgtcacctcggtcatacttctgacaccaggtactgtattcattcttggaaaagcaagtcgctgtcagagagaaagagcataattttaccttgcaatttttttctaagtaactacctattacataatttatttttcccaagttctaattctcactatgccatatgatataatatggtttcaattttaaaaattcattttatatgttttggatttgttcacaaagttgtttactacgtggaaatgcttggcatatattaaaattacttatacaatcacttattcatgcttgatcaacttaaagacagtggcataaatataatgattttatatatttcatagaattcctggacattatatcaagggtgaattaagaaaattattaaaacaacatatgttgagtgtgaactaaggagaaggtgctaaataggtactactgaatattacataaagtataaaccagtgtcataaatctctcaggaaagaaaagacactaaaatccacagaagaaacctacaacaaatacagatatatacatgcactattgagtaagccaaagagaagtgctattggagttgagaggagaaagagaaatctttcaaaagaaagttcatggagaaggtagtacgtaaagtgggcttaatggagtaatggtaggaatttagtagccagagagtggtaggattagggagagaagaaagcctttgcctataaaataataatatagagctggacatggtggcttatgcctgtaatcccagtactttgggggactgaggcgggtagatcgcctgacatcaggagttcgagaccatcctggccaacagggtgaaacctcgtctctactaaaaatacaaaaattagccaggcgtggtggcaagtgcctgtaatcccagctactcaggaggctgagacaggagaatcgcttgaacctgggaggcagaggttgcagtgagccatgattgcgccattgcactccagcctgggcaacagagcaagactccaactaaaaaataataatgataatataggagttatcatagaaaaacattgtggccatagataaaacagtatgtaactgttttatccgttctcatgatcatagtagatgcctatttgtgcaggcaaaaaagttttaattctcagtaaatacatacacaagcattagaccttaagatgaaaaaaagtagatattataatataaaacctttttccacaggtacaacaaatgtgggcaaattataatccaggcttaaactattaccccaaaatctaaatgagaaaaggacgatctgtaccctgataccaaactagataaagatatcacaaggaaacaacatgccaataccccttatgaaaatagatataaaactcttcaacaaaatagtagcaaactgaatctaactacatgtagaaagattatacaccatgaccaaataggatatattccaggaaaaacaaattggcttgtatgaaaatcaatcaatgtattatacctacattaatagaataaagggcaaaaagcacatgatcatctgaacagacacagaataagcatgtgacaaaatccaaaaaccatttcctgacaaaagactcaacaagctaggaacaggaagaaacatcttcaacttgacaagtatctgtgaaaaacccaatagctagcatcatactgaagagcagaagactgaaatcagtccgcctaagaccaggagatggtagacaaggatgttcattcccagcatggctatttaacattatattggagggtctagccagggctattaggtaggaaaaacaaaaacaaaaacaaggacaaccagataggaaagaaagaagtaaacctgtctctattcatagaagacataatgttgtatatagaaaatcttaaggaatccacaaaaaaacctattataataataaatgagttcagcaggaaggaagatttcagaccaaaatgcaaaaatcatttgcatttttagccactagctatgaacaatcccaaaataaaattaagaaaatgattccacttaaaatagtttcaaacggaataagatacttaagaataaatttaacaaaataaagaagtataagacttgtgtactaaaactacaaaacaaaatggaaagaaattaagacctaagtaaatggaagtatatcttatatgaattgattgaaagacttcatatcattaacatgacaatactccctaaactgatgtgcagattcaaccaaatctctatcaaaatccctctttctttcttaaagaaactacaagttgattctgaaattcatatgaaaatgcaaaggactcataatagtcaaaacaatctcaaaaaacaattcaaagacttatacctcctgattttaaaacttactgtaaagctacagaaatcaaaacaatatggtactaggataggtatagacatatggatcaatggaatagaattgagagttcaaaaataaacccatacatctatagtcaattattttttgacaagggagtcaagaccattcaatgaggaaagaatagtctttccaccaaatggtggtggtacaactagatattcacctgcaaaagagtgcagttggacccccaactcgtaccatatacaaagatgaactcaatgtggaccaaagacccaaaatataagagctaaagctataaaacttttagaagaaaacatagggataaatctttgtgactttgaattaggcaatggtttcttacatgtgacaacaaaagtgcaagcaatcaaataaaaaatagataaattggacttcatcaaacttaaaacattttgtgtatcaaaaacactatcaagaaagtgaaaagacaacccaccgaatgggagaaaatatttgcaaatcaggtatctagtaaaggtctagtatctagaatatatcaacaactcttgcttctcaaaacaaacaaacaaaaaaacaaataattcaatttaaaaataggcaaaggatttaaagagacatttctccaaagaaagacaaatggccaaaaagcatatgaaaagatgctcaacatcattcagcctcagggtgaatgaaaatcaaatcacaatgaaataccacttcacatccactaggatgattataagaaccaaacacaaacaaaaaatggaaaatagtaagtattcccaggatatagagaaatgggaaccttcttacattactagtagaaagataaattgtgtggcctctgtggaaaatagttcagtagttctcctaaaagttaaacacagagttaccatattacctagtaattctactcctaggtatagactcacgaaaactggaaacatatgttcatatagaaactagtacatgaggttcataacagcattaatgataatagccaaaaaagtgaaaacaacccaaatatctatttcccagagaatggataaataaatgtgatgtggcggggcgcggtggctcacacccataatcccagcactttgggaggccaaggagggtggatcatgaggtcaggaagccgagaccatactggctaacacattgaaaccccatctctactaaaaataaaaaaaaactagccaggagtggtaacacatgcctgtagtcccagctacttgggaggctgaggcaggagaatcacttgaacgtgggatggtggaggttgcagtgagttgagatcgtgccattgcattccagcctgggtgacagagctagactccatctctaaataaataaataaataaataaataaataaataaataaataaataaatgtgatgtaaccatacaatggaatactcctccactgtaaaaaggaatgaagagctgatccatgctgtaacatgaattaaccctggaaacttcacactaagtgaaggaaggctggcataaaaggccacatattgtatgatttcagaataggcagatccctagagataggaaatagatttgtggctgctgtaaggtagaggtagggagaaaatgaaatgattgctaataggtatgaaatttctttgaagggggatgaagaaattattctggaatttgatagtggtgatacatgtatgactctgttaatattatatattttaaaaacactgaattgtatacattaaaaagatgaactttatgatatgtgaatttcatctctattaagctatgagtttgataaaaagatgggaaagctgttgggggagaaaagtgtaacctggccacaaaagtgccagacatactaaattgccttaaaaacttgtgtaactccaaagaggcttcaggagcagttccgggagagagagcgttgcagtctcctgcgtgagcgagcttcgtgaatggagcacagttgcctggaacaatcaggctgaggattcaatccagtgcttcaatgcccaggaaacagatccctgcacctgctgaaatcagatgaccagggtttagaggggctgggggaggaactgcaaagccaatccttgttttgttttatggtggtggtgctgatgatctcacacagctggggactttaaccactacatatttctaacgaatatagaggaagtcaagttttcctcagggtctgtggagcatgtgtttctgcctctacttttctttgagcagaattgtgctttgtgtaagaacatgattactgcagattcgatcttgtggttgtctggcactccctttgggacttgaaagcagtggtgtctaggggtttgcagttactcccaccttccaaggtgcatgtgaactttcatgtcaccccggtccaagggctgtcacgagtgtcactcaagagtggaataaggccggtgtggtggctcatgcctgtaatcccagcactttaggagggcgaggtgggcagatcacgaggtcaggagatcgagaccagcctggccaacacagtgaaaccccatctctactaaaaatacaaaaattagctgggcttggtggcaggtgcctgtaatctcagctactcaggaggctgagcaggagaatggcttgaacccaggaggcagaggttgcagtgagccgagatcgcgccactgcactccagcctggcaacagagcaagagcctgtctcaccaaaaaaaaaaaaaaaaaaagtggaattaaatggctgcccggagcttcttacaccgaaatgtccacagcagcaaagcgggttgagaaccaggtcctgggaccctgtcctccaagctcaactccaggcctggcaagcagtagccctgcgtcttctccacgcacagggagtggcggcaggcctcctccctccagcacagcagctgaccctgccagcatctacattcagttcttttgcagccaaggcaaccacagcagcctcccctctgcagtaaacagaggatgcagttgctgggaactcttctccctccatgctgacggccagttgtcaggggcaactgctcctggagaagctctagtgaatggctgaattccagagaaggctttggaggggaatttgcttttcttgttccatcacaatacacatgcagctgagccttgcttcaccttttggttctgctgggctttcatgggtgctgtttgtttctctgggctgtgctgccctgggatggggtgtccaaggtttaggcctctcccacagggctgcacagcaaatgttgcaccgctgctcccgcaccgaggcctgactgcatccactctcctgcaatacagcaatggcttgtgttttggcataaaattccatcaggcagaggaggtatcaaatcattcaacctgccactagctccagagcagtgtcaaattcactaatgtacagagcagtgtcacctcgacagagaatgcctgccaacagagccagcatgaatgatcccggctaggagctgagaactccatgctaagtgccagacagaatgtggaaagagaagatgccagtacttcccatgaagcttagagtccacgtaaagacaatgcatgtgcaaggagaattccacagtagtgttatcattaagtaaaaataaaagtcaaaggcagggtgtggtggaggcctgttgagttgtgtagatagtggaaatgctgacctagagggctgagatcctcgccaaggcaggagtggcttccaccggtgaaagtgaaagatgacagtcagtcttcaacagtggagaatccaagtcgtaaccgtcacacttcgcatatgtttgcacacagtgttgagtgcgttcctacccaacattgcttccattttggtagatttagttagaaattgtaatatgtgcttttttaaaaaaatagtatttttcaagtactaccagtcttgtattctggtttattgcaactcagagtacagtatctgctttctacttaattagaaaatccattctgaactcacttgattcagtcgttttgtgaaagtggttcctggtacccaggggccccttgccacccctgtgagaagaatctcatgcgcatggtggagtgccctcctgatgacgcagacctggaagggcctcatggtaatcactctgaacaacaaggcatcttgtcctggagtacagtctaattatcaccagttatgcacaattgatgttttagaaatcaaattaaaagtgttcaaggtgatcttagttccaaagggatttaccaagtgagaatatgtccctttcaatgttgtcattcatatctcccttgctggtccatgctcttttctaaatttcttctctttggaataataggctcaacgttacattttttattttcaatattaaatatgtatctgtctacaataggccatgcacagcgtatgccttttgttagcagctacagttcccgcattctgatggaaacaccgtgaccttctccggtgccacaatcgctgacgtgggggtcggaaactccagcaggatcggatttgcatgaaaacatccctgacaattggcttttatggaatctcacattagagcaggtggacagtggtttatgccggaaacactagaacacttttaggtggtacatcaatgagaagccttgaataattcaaagtcatagtgaatggaggttctgggttaaggccaagcacaggttatcagaacacaagactcgtcagtcttttgggtagaaacgtaacatagagattacttttacggaattaaaatgtcatcactgtttaatgtctgtgaccgcattgccaaccctcaccttatctttttaaaattcttgaacaaataatttcaaaacattttattgaagaaggatatacatataggatatatattatatatttaacataaatattatatagatattaaatatataaatataaacacatgtgagtaagctattgttgaattttgatgaattttaaaaccaaacttgattctgtaatcagcatccaggccaaaaaagcagaatgcagccagcatccggaaagccccccaggcccttcctatcattaatcctctcaagggcaacctcatttctgacatcacagagtagtattatgagtttttatattctttgcatttatggcataaatgtaatcatctggtatgtctacttttatgcctgcttttgttctatatgtttgtgagattcatagttgtattttagattgtactgctacccaatttttaacctatattggattatcttatcataaagtcccacataatctcaatgaaaattgcaaaatagcttaacagtcatttaatagcttttgtgtgtatcataaaaagtaatgcatacctcctaatttttttttgtcttgtagaaatagatggcttgctccgtatcttttgggcattttctctctgttagggctcctatattaaattcattccacaaattcaatcttgttatattccatctactaacactgaccatggcccaacccatttcatcatgggaagcacaggtggcttgagtgggttctggtattgttcatttgccctggggcatctgctctgtgagtcctgggctcctccgtgcctgctcacacccatctgcagcggactgactggattggggatggtgtctactctgatcatgaaacacagagttgttttggctgctgccgatgctaccactgttaatgtttctgcccaaagttaacttgttaatactaatcgagactgggtgctataaatagaggctgcagatgatattcattatgatggtccaaaacatgggagaggccattgagaacaggatacattcctggaaggcttcgtggagaatgagcaattagggactttaaaagatagatccagtagagatggaagaaaactgagagggaaagccatgagccctcgggggacagaggacagtctggccaggaagttgtggaggggccaggtgtggtcaagagttaagggagaaggaaagggatggtagccaatggggagagcctggagcgcacagggcctggatttgagactgaactctaacttctcataccgtttacaccagtgtcctaaccagtttcagaatctgatgaaaactgtaagtcatcttatcgttggaaggaaagaaagggcattgtgtgcacataaacatttggatatgttgtattaatataacgtttgcaaacctagtcagtccatcccagggccatctcagggatctgcttgagcgtttatccaaggtccaggtgttaaagtttgtcagccaaaatatttttgtctgtgagtaacagaacagccaactaaaactgttccaattgcaggtgtccgtattgtttcacaagacaagtttagacatagccagtccaaggcagattcagtgctcgtggatattgtcaaagtccaggtgggctccatctctctgctgccatcagtatgtcgacaacatggttgtgacggcttcatgcttcactcgcccacacgcacaggaagggatggacacatagaacttagcttgtgcatctcacttcctctgtcatggaggaaatagttttctgagtagttcctttcggttccccggagctgcgaggagacagcttatttgctgtaaccatattgcatggctaccttcactggagggggttggcaaagcccgccatttgtaggagtcaggctctgctgagtcagaagaaggcagagaggcactggctcttggggaagcagccttcagtgtccaccaccacgagcaagaccccttgatttgtgaaatccttgaggaatgtggtctacattccttgaacatgaccagtgaatttgagtcattctttaaattgaaacaaatcttctccctccaaaaggagggagttctgacagattctcatagaagaaataattaggttacattgctactaaccctatagtgagttgcaaacttgcaaactactgaaaagtgggtcgctgggaccatcttaaccgtctctcttttgatttcccatcattaattctagaaggactactaggtgcatctcgcttatttatggagtccttacactaaagagccatttttctaaaggatggcagtagatgcttattattcacactcgtgttaagactataagctaaggcaaatgggtctacatatttatctataaatggacacttttcaagtgttgctgcattttgcatcctattttaaaggcaaccatgaaaatgagtaaatcttatgctgggaccctggtttcctctggagtctcttgcctgctatagatgagtgcctcctggtcagcttcaaattaattttggtggccttaaggaccatatttttacaagcagctggctcctatattagttgctagtttagtgaagactctggcagtccagaaccaaaggcagcaattcaggagtttaagcagagttaccataccatgtcagggtcaggaacacagaaagctgtgatataataaaatcggagaactggagagcaattctgtaaaatgaactaagcaggtcggggaactaggaagatgaaattccagattgaaatggttccaaattctctgaactcttcaccttaagccctgcttggacaaccattgatcacttctgcagaaacagtatatccatgcactttctcagattgctacttcataatcctcaaatcccagatattctaaattgactctgtgcatttaagtatggtattaaaatcaccagaagttcagttaagtgataatttgcaggacctcccatttaatcagtctctttcttgcttttcccctactcagattcttcatgtctttctttttcattcagtaaatgtatgatcattgcagcctcagaggatgccttctaaagtggtgggttggttggaaatgggagaaaggccttgaaggatgcggtaggctaaaaaatgcgccccccccaccaaaaaaaaagtccaagttgtaatccttggatcctgttaatgttttcttttatggccaaaagggggccttttgtggctacattaagcatctgaaatggaggattacccttagttatccaatggaacctcaatgtgatcacatgtgttcttataagaaggaaataagaatgcttgtgatttttgtacattgattttgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaagtgggcgaaggacatgaacagacacttctcaaaagaagacatttatgcagccaaaaaacacatgaagaaatgctcatcatcactggccatcagagaaatgcaaatcaaaaccactatgagatatcatctcacaccagttagaatggcaatcattaaaaagtcaggaaacaacaggtgctggagaggatgcggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatatcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggtcgggggaggggggagggatagcattgggagatatacctaatgctagatgacacattagtgggtgcagcgcaccagcatggcacatgtatacatatgtaactagcctgcacaatgtgcacatgtaccctaaaacttagagtataataaaaaaaaaaaaaaagaaggaaatagagggagatttgacacagacgaaggaggaaatggcaaagtgaccacagaggtggagatgggagggatgtggccacaagcccaggaatactggcagcccccagaggctggaagagacaaagaacagatgtgatatggcttggctgtatcctcacccaaatctcatcttgaattgtagctcccataattcccatatgtcatgggagggacccagtgggaggtaattgaatcatgggggtgggttttttgtgctattctcatgatagtgaataagtctcatgagacctgatggttttataaaaggcagttcccctgcacatgccctcttgcctgctgccatgtaagatgtgcctttgctcctcctttgccttccaccatgattgtgaggcctccccagccatgtggaactgtgagctcattaaacctctttttctttataaattacccagtctcaggtatttcttcatagcagtatgaaaatggactaatacaagatgcttccccagaacctccaagagcgtgcagccctgctgacacttgtatttgggcccagtgaagctgattttagacttccagtctccagaactgggagagcatactcttctgttgtttgaagccatcaagtttgtggtcatttgtcacagcagccacaggaggctaaaataaagggagataaatggcattgccacttttacggtggccatgtcttacaggcaggcaaaagaatgcacttgtggagagatcagaactagaatgcttagaagccatgtgccagcccttggaagaccatgaactggacaacaactgtgccacgcactgccctgtctgctccttcctgccattcacaatgggagtccatgctgggctcctagctcagctctctaggggacaaccctgagtttcaaaaggtggttctttaccatcttcaccacaaagaaaggaaatgaaattctttcaaattgagatgtattttgatgtttttcaaaatttgagagaaagaggaaggaagaggagaggaagaggaataggaatctccagtattgacttaattcttcttattttacatacattcaattaaacagatttaagctccacttacagtctatgttattaaatttgtcgagatgggagatgaaatgcagattaaaaaaaagaagccaatgaaattcagattaaaaatatacattgtatgtgacagataatgataatttctgagactaagtaaccccttacaatgtgtaaaggtgtttgctacgtgtcacaggtattttgggtttagcatgcctattctcgtaggcatcgggtgaagaattgttccacccattatttccctattgggagcacactacacctgtgtttacacagcaagccagtcatttgggaaggttaaattattaatagctgaccttggtgttggtacatcatgaagacacataccgattcaggctctcaattcaggtatgagtatatgtttatgatcagaacatgattttattaattttattgaacaagtaatatgtataaatagaaaaacagtagaaatatattaaattggctgggcatggtggctcatcctgtaatctcagcactttgggaggccgaggcaggcagatcacctgaggtcaggtgtttgagaccaccctggtctccgtatctgctaaaaatacaaaaattagacaggcgtcatggcgcgtgcctgtaatcccagctacttgggaggctgaggcaggagaattgcttgaatccgggaggctgagccgagatcataccactgcactccagcctgggtgacagagtgagattccatctcaaaaaaaaaaaaaaaaaaagaaaagaaaaagaaaagaaaagaaatattaaatgaacaataataatccttttataattattttctcatactgtcagttctacaaccagtccctagatactgtcactttccaccatttctgatttaagtcttctgatatttattcatgtgctttttttttttttttttttttttttgagacagagtctcattctgtcatccaggctggagtgcaatggcatgatcctagctcaccacaacctctgcctcctggattcaagtgattctcctgcctcagcctcccaggtagctggtattacagacgtgtaccaccacacctggctaacttttgtatttttaatagagacggggtttcgcgatgttggccaggctagtcttgaactcctgacctcaggtgatccacccgccttggcctcccaaagtgctgggattataggcatgagccaccgtgcctggccttattcatgtactttttaatatcatgctgatatgtcaatgtccacagactaccgactacgaaggtcaaaatttagctgctttacattttctcccacttccgtctcttcactctgagttacaaaacctataatgctatttcaagtcctctatagatgtgtttcataaccacgtgggaaaattttttcatgtataaatttcttgttccattgattctaaatgcgcctcttgacttgtcactagataatatgggaaagaagcatgcttaaaagactttcttctcaatcccagcttcctactctttctcttccctttaagtaatatttgcaatatttttttcactttaataaaatctctcatcaaataataagttggtttttaaaatcaaaaacacatttacaacattcactatttcattttttaatttttaatttctgtgggtacatagtaggtatgtatatttatgggacacatgacacattttgatacaggcatgcatgaaatgataaacacaccagggtaaatagagtatccatccccttaagcatttgtcctttctttgtgttgcaaacaatccaattatactcttttagttatttaaaaatgcataataaagtattattgactgtagtcacattgttatgctatcaaatagtaaatcttactctttctaactctatttttgtacccattaaccatccccctctgcccacccccaccatccaccactacccttcccaacctctgataaccatttttctactccctagctccatgaattgtttaatttttggctcccacaaataaatgagaacatgccaagtatgtctttctgtgccaagtttgtctttcttagattatttcacttaacataatgacctccagtttcattcatgttgttgcaaatgacaaatctcattcatttttttgtggctgaatagtactccattgtgtatacgtaccatattttctttatccattcatctgttgatggacactagggttgcttccaaatcttgggtattgtaaacaggtctgcaactaacaaaggagtgcaggtgtctgtttgatacactgatttcctttcttttgggtacatacctagcactgggattactggatcatatggtaactctgtttttagttttctgaggaacttccaaactcttctccatggtggttgtactaatttgcatttttatcaacagtgtatgagggtttccttttctgcatatcattgtcagcatttgttattgaatgtcttttggatatgagcctttttaactggggtgagatggtgtctcattatagctttgatttgcatttttctgatgatcaatgatgttgagcaccttttcatatacctgtttaccatttgtatgtcttcttttgagaaatgtctactcagatcttttgcccatttttaattggattattagatgttttcctatagagttgtttgagctccatatatattctgcttgttaatcccttgtcagatggatagtttgcaaatatttactccattctgtgggttgtcttttaactttgttgattgtttcctttgctgtgcattttaactcaatgtgattccaattgtccatttttgctttggttgcctttgctaaatagggtattactcaagaaatttttacctagtacagtgtcctggagagtttccccaatttttttttaagtagtttcattgtttgaggtcttacatgtagtcctttaatccattttgatttgatttttgtatatggtgagagggaagggtctagttttattctcctgcatatggatatccagttttcccttcaacatttattgaagagactgtcctttccccaatatatgttcttggcaattttgctgaagatgagttcactgtaggtatatggatttgtttctaggttctctattctgttccattgctctatgtgtctgtttttatgccagtaccatgctgtttggattactatagttctgtagtataatttgaagtcagataatatgattcatccagttttgttcattttacttagaataactttggttattgtggatcttttgtgattccatgtaaattttaggatagttatttctatttttgtgaagaatgtcatcagtattttgatagagatttcattgaacctgtagactgctttagatagtatggaaattttaacaatattgattcttataatccattaacatagaatatatttttattttttatgtctgcttccatttctttcatcaatcttttatagttttcattgtagagatcttttacttctttagtaaggttaattcctgggtattttattttatttgcagtgattataaattgaattactttctttttttaaattttattattattatactttaagttttagggtacatgtgcacaacgtgcaggtttgttacatatgtatacatgtgccatgctggtgtgttgcacccatcaacccgtcatttagcattaggtatatctcctaacgctatccctcccccctccccccaccccacaacagtccccggtgtgtgatgttccccttcctgtgtccatgtgctctcattgttcaattcccacctatgagtgttttcagattgttcactgctggcatatagaaatactactgatttttgtaggttgatttttgtaacctgcaactttgctgaatttttttatcagttctaattttttttagtgaaatccttaggtttttccaaatataagatcatattatctgcaaacaaggataatatgggcaggtcgagaaatatcatccaagaaccaaggcctagaattggggaccccaagagcccacttagtaccctgccgctttgtggctgagctggtacctaagttgcaacacaaagtgctttttacctttacttctccttttcttttttttttttttttttttttttttttttgagacggagtctcgctctgtcgcccaggctggagtgcagtggcacgatctcgactcactgcaagctccgcctcccgggttcacgccattctcctgcctcagcctcccgtgtagctgggactacaggcgcgcgccaccacgcccggctaattttttgtgtttttagtagagacggggtttcaccgtgttagccaggatggtctcgatctcctgacctcgtgatccgcccgtctcggcctcccaaagtgctgggattacaggcgtgagccaccgcgcccagcctacttctccttttcttaagcagaagaagtctctccctgtagccccacagctgggaatgtcctgggtcacacctgaagccagcctgtctctgagtcttacccaagaccctgagcaagtactgcctgagtaccactgctactgattatttagggcccaagggctccttagtcagcaggtgaggaatcctgccagattgggtttttccattcaaggcaggcacagggtatgtttagaaatgtcatcccagagctaggacctggaatgagggcctcatgactcttcctggtgctctattctactgtggctgagctggtatccaagttgcaagacaatttcctcttttctcttccctctcctctcctcaagcagagggaaagagtctctcctagagctgcaagctgtgctgccttgggtttgtgaagaggtgatgcaagcactcccttggccaccccagctgctgtctcactaggttgtgtgtcccccaagtgtactggctctgagccaagaacagcaccaagacttgcgcaggaattgcagttcttgcggcctagactgcctttcaagttattttaggaccccagaccactttagcccacagtggtgaggcttgctggagctcaggttcccactgctgggatatgcagttcccgaatggctagggctggtctcagtgctccgtccgtgggaattgactgagttctgcctagcgttgctttactctgtgacaaagcaacactgagtttcaatgcaaagtcccacagtcactgcattctccctgccccaagcaagcagattctctgccacacaactgctgccaggggatgaggaaggggaaactcaagactgtctttcccactctcttcagtgctacttcagtgatatgaagtcaaaaccagatactgtgatcattaatctgatttttggttctttacgagctgctttttcctgtgaatagttgttcaattggtgttcctatagagaggatgatcagtgaaggcttttatttggccatcttgctctgcctcctttcaaaattcacaattttatacttaaacaaatatttctgttgtaaatctgaagccatagagagaggaaaaaatatataatcctgtgtaactgaacaacttttcttgaggcattccagtcaagtggacttttcttaaaattcattaatagttacaattggtctattgatattgggaccatgacttacttaaataaattgggttttctcaataattttattggattatttctacttgaaataaactgtccttgttacagacaaaatgaatgcctgcacaaaatatgccaaaataatatatgtatagtagttccccttatctacagagtatccattccaagaaccccagtggatgcctgaaaccatggatagtgctgaatcctacttatactatggggttttattgcacatgtatacctacgataaaatttaacttataaattaggtgcagtcagaaattaataatgataactagaaataaaggagaaaaattataccaatatactgtaacaaaagttacatgaatgtgttatctctcactctctttcaaaataatctcaatatttctagaccatggtcaactgatggtaactgaaactgtggaaagcaaaaccatgggtaaggaggggcctactgtaagtaagtttagaaaggttacagaatgcaaggtctatttacacatattaattgcatttctatgtactagcaacacacagttgaaaaatttttgaaaatacaaattttattagtcagcttgagctgtcaacaaaatatgcagactgggtgatttagaaaacagaaatgcaacaaaagccaaaattggcaagtgggatctaattaaactaaagagcttctgcacaacaaaagaaactatcttcaagagtgaacaggcaacctacagaatgggagaaaatttttgcaatctatccatctgacaaagggctaatatccagaacctacaaaaaacttaaacaaatttacaagaaaaaaacaactctatcaaaaagtgggcaaaggatatgaacagacacttttcaaaagaagacatttatgtgaccaagaaacatatgaaaaaaagttcatcatcacaggtcattaaagaaatgcaaatcaaaaccacaatgagatactatctcactgcagttagaatgatgattattaaaaagtcaggaaacaacagattctggagaggatgtggagaaataggaacacttttgcactgttggtgggaatgtaaatgagttcaaccattatggaagacagtgtgttgattcctcaaggatctagaactagaaataccatttgacccagccatcccattactgggtatatacccaaagggttataaatcattctactataaggacacatgcacttgtatgtttattgcaggactattcacaatagcaaagacttggaaccaacccaaatgcccatcaatgttagactggataaaaaaatgtggcacatatataccatggaatactatgcagtcataaaaaaaatgagttcatgtcctttgcagggacatggatgaagctgtaaactatcattctcagcaaactaacacaggaacaagaaaacaaatactgcatgttctcactcataagtgggagttgaacaaggagaacatatgggcacagggaggggaacatcacacactggggcctgtcgaggggtggggggcaagggaagggatagcattaggagaaatatctaatgtagatgatgggttgatgggtgtggcaaaccaccatggcacatgtatacctatataacacacctgcacattctgcacatgtatcccagaacttaaagtgtactaaaaaaataaataaatgcagaatttcatttctcacacttctggaggctggaagtccaagatcaaggtgtcagcagggttggtttatggtgaagtctcccttcctggcctgcagaccgcaccttcttgctgtatcctctccctgctttttctctgtgagtgcacatatgtgtgcctgaagagaggaaaatagagctcttgtttctcttcctcttttttaagtacagtagtcctaccagattagagcttcaccctctgatctcatttaacttcagtttcttccttaaaggcgctatctccaaatagaatcacattgggggttagggtgtcaacatatggatttgttggtacgtacaattcagtacataataccagtgcacgtggacgtctttgggatggccctgtcttacctaacacagtctgttctctgacccgcaaagattcacatccttctcatatataaagcacattcattcactctaccccaaggtccccagaaatctcaacctattatagtatcaactcaaagtctgtgatctcatcagttcagaactcccaaattttaacactgaaatcatctgaatgagttttgagtaggcctcagggcatactccacccaaagcacaattcatctgtactgtggctctgagaaactggagaggtaaacacagtagtgggacgggtataggatgacagttatagacattcttgttcaaaaagggagaaaaaggagtcactagttccaaacaacttctaaattcagttggggaaactgcattaggtttataggcttgggaatagtatcctagggctctcaggtctgccctctgggagtcatctttcttcttcatgaatggcagcttgagattgtagctgagtagttttataagcatgttttctgcctgagaattttgggggtctgatatggtttggctctgtgttcccacccaaatctcatgtcaaattgtaatcctaacgtgttgaatgagaggctggtgggaggtgattggatcatggggctggtttctaatggttcagcaccatccccctagtgctgtcttgtgatagagttctcacaagatctggttgtttaaaagtgcgtagcacctccctctttgctttctttctctcctgtcaccatgtcacaaagggtgcttgcttccccttttccttctaccatgattgtaagtttcctgaggcctccccagccatgcagaactgtgagtcaattaaacctcgtttcattataaattacccagtctcaggtagttctttacagcagtgtgagaatgggctaatacagcgtccaacagcctttatttgtttcatactccctctctccttttcagtccaagctggcaatgtttctacagatataaattcttaagaatctgcggatcttctatgtatgtcatgggaattcattccattagacaagtggctcttcctaggattcttctagatactttcatctctatgtttgccttctgctgagagaggtttggggtctgtgaatcacacatttaagctcttcaaagggccttttgtgtgactgaatacttaccttttgatctttcaaggtattagcaaaggtttttcagccatgctctcaggatggcagtatctttctcgacagtgaatctcttaatttcagcattttttataatctgaataaagtgacacatttctccaaagaagatataaaaataaccagtcagtgcatgaaaagatgctcaacatcattagcttgtaatattattcatctataaaaaggaatgaagtagtggtacattctgtacgtattacaacatggatgaactttgaaaacacaatactatctgaaataagccagtcacaacaaaatgcatattgtatgattccatctacattaaatgtccagaatagccaaatgtttagagacagaaagaagatttttggttgcgaagagctgaagagagatgtgggagaatagagagtggctgctaattgttatgctaatcttttgggggtaataaaaatgttccaaatttaggtcagtaatggtgcacaactctgaacatactaaaaccattgtgttgtagactttaaatggctaagttttatggtatgtgaattttatctctaataaaggtgtcaagaaaggaataaactaggtagggaaacatatcaacctatccgcatataatcatgtgaagtcacaggtgcctaatgcggtaactcactaaagaaaacaggctgctgaatatattttaaggtttcagtttatttcctggatctaaaagaatggaggtaaggacatgaagagggaatgtatacctttgatgtatttgatttagaagcttaaaataaagcataactacaatttcttagttcataagatgtgctgaataatgctgatgacttagtttctaccatttcaataaaaagtattatgtgactaattttgatgttatgctactagttttcttagactatttgaagacatgtgaatttgtaaggagaagcttttaagataaattagtatctctgtgagactttttatagacataagtctggagtataaccataaataatatactttagtaacacaaagactgcattacaaaaaagtaagcgaaaatacaagcaaaggcacagatttttaaaacaaatgctctcttcattcaaaagaaatgaactgaacatctgtttgctgggccccttagagacatgaagttgcgattcctaactaaaacagaaaaggaaaatatcaagctagtatgggaaatagacttgaaagcaaataactagttcattgatagtagctcctggtagcagaaaagaaagcatgatcaactttgagaaagtaaaacacacacacacacattgtaaagaggtactgactgtacattttcttgtagctcctctagcatcactcaggtaagattatttaatgcaattctcatcccaacaatagttattttgtttcttacatttggggttggatgactctagagagatttcttcagagaaatatgtttttgtgtattttgagtaaatctcacttttgtaaagagagagagtgttcccctgactcacagctgctgccacggcttccttccgtctctagggtttttgtgtatggatgagatgttaccatctcagctctgacctatggattcatatggtgaacaatctgccagtgggacagtttaattcaggaataggtcaaaatccccaaggttcatatggtgatttgcagacgtgctacctggttttaaatttcattgtttctaatctcttgatggtacagcatgatataaatttattctttcattatgataagaatctaccgaggaaataggagtagcacctgcaacacatagcatggattctacctcttttactttaagaaaaaagaaagaaatataattggaagtcttgttcaagcatctgcagtgcctgactcagggcactcaatcaataaatatgctggcagaactaaatgatgtgtttcctgcattctcattgagctttttccttgttactaagcagcatctgtgttaggtccatcgctgacggaacaggctgcagtggtttatttttaagcaaaagtgatctcattggaatttgtgaattaatggtaccgacgttggaaaatggacagcttctttgatttccacctgtttttgtgaagtgttggtaaggaagcaaacaaatagtatccattttgtaggaataacatacaaattgttctaaatacaaagactgctttactctgagcctcagcttgggggtctgtctcccctgtgaagctagccctccataacccttgtctcctttgagttttgaaaacacctagtgcttgacatctgccaaccgattcctcacacatctttggaggagtcatttcacctctcagcagctcagtagctcaatgtaactttccttcctcctcattatggtggggatcaggagagataataaatatcattgcactcggaagactataaagcactttagagttgtcagttattccaaattgctcacaaaagcagaatctcacagaaagtcttggactcttctgggtagattttctttgttaccaagctgagtttgtcagtagcttacctctacctgcagggattgcatgcccctccagcagctatgctcgggtgatgggatttatttctagttttctggtatttaaaatatttagagaaggagttccaaatggttctccaggaattttactatttaacaaatatctgaggaagggaaaggaggctgagaaatttgcattacacattggccaccgtaaagagtaactacatcactgcagatttcagcatgcctttacatgctggtgagctaaccaggccaagtcaatttgaagtgccatggagttttctatagtatatcaagctaaagggctggaaggaactttatttttcagtgatccctgaattgcctttgggatgaaatccaaacagtgaaagccactgccccttcttgcatcgccacctttatgttgccttccagtttaagaaggaagattgagcacagaaatgttccttgttttgatggcaaaagcatgtggaagtgacagcaaaataaataacgaaaaacacagctgcagccgggcatggtagctcacacctgtaatcccagcactttgggaggctgaggtgggcggatcacctgaggtcaggagttcgagaccagcctggccaatatagtgaaaccctgtctctactagaaatacaaaaattagccgggctcggtggcaggtgcctgtgatcccagctactcgggaggctgaggcaggagaatcgtttgaatgttggaggcggaggttgcagtgagccaagattgcgccaccacactcccgcctgggtgacagagcaagactccgtctcaaaaaacaaacaaacaaaagcatagctgcttctttctcaaaaacaagaacaggagttcttcacatacctggattgaaagggaagacatcctcataagaaggaacaggtaaaaacctatggcaggagggaaggccaaatttccatcatcctcaagtcatagagactgaagtcaggcacaacaggagggcttggaaggttggttttcatgagagaccaggggtacatggagtccctgcctgaaaactgggttcatggtcagaaggcctcagatcacatcacccatttgggggaaagggctccagcctaaatgaccaccaagacttagtttagagctgttacctagacagaatctcaaaactgcctgaggaccacccaaccaggggcctctcaagacccagaacacttgtaagacagaagcttacaaccaagaaccacaaagcatcttcagaaaacatccccccataaagcagaaaccaacccaacacacatgaaaaccaaaatccaaagaaatttaaatcaatagggaaaagagaaaatgacattttagatttttgaaataactatcactatgctaaagaagcatgaaactataaaatatgagtagatgatcttgaaaaaagttatttagatatattagatattaaaatgtaattattttaaatttaaatccttagttgggtaatagaacagtctaggtgtattaaaatattgacaagtaggagattgaactgaagaaatcatccaaatactcccaaagtcaaaaaggaaaaacttaagaaaaagcccgaggtgtggggattgacctagaagctccagcacagtccagatgggattctggaaggaggggatcaaatgctgcaggagccatattgtatgagataattactggtagtattcctgatgtgaagaaaaatagtctttaagctgaaaatattactgactgttaagcagaatttttaaagaaaatccacaagtggacattttttctaatggaatttcagaatatcaaatacaatgagagaatctcccttcccctctaggatttcctgttcacattgtctgccacgccaatgccaacacacacaatctcttgaaaatactgcatccaccgacaactttctgcccttatgagccttcctagcttgaatgtttttctctctcctttatcttggctagcagcctctttccttcagcaagtcctcctggaatcaatccctcccactttcttatttaatagtctgcttccatattagcaggacaagccctgttcctctcagccccgtccctgctatgttctgatcattcattctgctttggttccactgctctgtgagcttgtataaggcctttctcttcttcagggctcagcatggtttgtggaatgtggcagtctcctgtgcctgtcattatctcagatgattttgggaatgaatcaaatgataaaccaatgaattagatatcagttgaatgtgcaaatgagccatctaggtacagagaggccagcagtgagtttcttaaggagacagagctaattaaggacagagtcatgtcctggcttgaatggagcaattttgatagcatatatcataatgcctccaccacatactttccctatatagaagtcttaagtgttttaaaaatacctttaaaaaacaaataaaattacagtttttaaaataaaatacatgtatagaaagaaagattttcagaaagtgaatacattgccttttcatcttttatttccaacgtttgtttaaatggcagtcttacatgttttttcttatgaggcacatagataccttaagttgcatggctagaatcattcttgaatagtgaagtttaatcagataaaatgtaaatttcaacatgattattattttctgaccacgtacttaagaatgtctcaggaagttttagacttcttaattgcaagatcagagtgtaactttattagattaatgtctagtaatttttaaaattctcatttattgtcgtgtatatggaagtgtgtcatgtttgaagccatgtgccttttcctgaggctgcttcagccacacctagaaagctcctagagcgaagaaagaacttggtttggtttaatgcactatgttcagcgcccgggatagctccatatacagtcatgtttcacaataaggccaccttgagtcacagcattctgtaattttcaaaagactgctacacacagtaaccctatttgatattcaagagatcagtcaatgcacaaaggaatacatgacttttctgacaatttcagtaatttgtcaacaaccagacccaaaaggaagaaaccaaaagtgacgtaataaaacccatgcaatgcactggggtcctagaagctttgaaaattttatttagagattatttattcctatttgtttatgtaatcctaacagaatttctttctgtttttctaacctgccacagagtttaaaacacaaaattaaaagaggcaaatggttctgtcaaggtcaagaacaacagtccaaaaagcgtaacagccagaaattgaaacaagaaacagacataccaccagacattgaaatacaaaaacacacagctctagagccactgaatgtggaatgcacacagacatatgcacctcagttagcaccaagatcaccccacatagcagcacaacaggaaactgttgaaatgagaaaactgggagtctttgaaaaaaatgtgcaatgatatttagcatcttctatttaagagggcagggaagtaaataagcatcctaggtagataatgtccatcagatgtggtcaagtcaatatacagaggagtttcttattagtatcacagaagtgaaggtggtggaatggactggcctgtaggctcacaggtcaggcatgctgacagccctgtgtcttttcaaagtcaataagtggatttttgtgcctctaatggagagagcctcttctgaggaggagcaaaaactctagaagctttgatctctggaaatacaggataaaagctctcagatttttaaagtctcacccactgacgccattaactaaacatctcatcttgggatgaacattagctgagtgtgttcacaggcttatcccaagtgctttctcctaagccttgtaacagagatgcggcaaggcagaatctggtagtctgtgtacagataattggggtttgatcctgtctgagcaagaactaacccacaacccagagacagccagggacaagtgaagcttatggagaatgaagacctaaggaatattttctgtgtctttgaattctcagcagctaaaatgctgcacttaatgaatgcttcatgattgaccaattacatcatatgactgaggtccattctggatatccgtatcttcctctcgactattcccaccctattgttcataaatcaatcctgaaagaattatttacctctgtgctgagaaatatgatcacttacatgctgcaggtgtgggtgagaaggcgtgatgccgttctactgaatcatgatttccttagcataggttttgatagtttaattaaaaacagaatgcaagactggcttttatccccattcacttatggacgtcatgtgtgttcccatccatactatttataaatgacaatcagaatgtttatggtcctctcattttactaattatgaaacaagcttaactctttgctttttatttttttctagcggaagataatagtctgtctcaaaagaagaaggtcactgtagaagatctcttcagtgaagacttcaaaattcatgaccccgaggctaagtggataagtggtgagtccaggtccttcgtgcacaagacatcgcttccccatgcctcacccccactttcaataggttgggtctagtaatttgcctctcggatttccccctttggccacagaaggggatctacagagcttttgctgtagtcatcatcagattatcattctatgaaaatgtgtatctggtaaaatcaggcttttgtaatggtgttgcctcccgagcatccacacagccttcacttaatgagaaatgggtctgctgaagacgtgtcctttgtgtgccacctcccagagacatcatttctccgggggagctgtggggtgttgcttagcaacaggaacagtgcagggcacggtgagctttccttccttctccacaatcttcattcccctttgttctcttgctctctttccgttaggcagaaggaccaaaagcaactcatggagttcttgtagaatagcttccaaatgaaacttggagtgctgtacacagatgcagattcatttattttccctgttgaactttaatttggattaaatctactttccttgtatgggggattttttttttaaaacaacagaacaaaatacagttgggggcagaaggcatatgttcacaatgcctgtgttggttcataacataatctatttcttctaattgggtctgaaataattcaagtgcatccatggaagatgtacccatccctccacaggccaagttgccagcacctccctgttgcctccattgctgttgcttacatttcatctttgcttcagtggaatacacttgaaggtttatcctcaggccagagaactttatagtgatcaaagtctagttcagatccttgcttttataataaatgaggtccagagaggtcaagtgacttttctgaggtcacagagctgatgagtgcgagctgtggctagcagcccgtcccctgacttccaattcagtgctcttcccaccatcctcttttgctgagtgatcgagtgtcgttgtatgtttttctgtcaaactgcttctaaaatgcttttcatgcttcacaaactctcagaaatcaattaacaatgactcttggctgttagtctcctgcttaggggcaatcacttttctttcgtcctctattgtggcttcagtattcatttctgacccttagattagcttatttaaaagtgaaaaaagtaggtggatctcagagggaatgtattttagaaaactggggagaaattagagcagcagtatatcatgaataccaagggcacacagaaattaaaaaacaaaacaaaacagcacagaggtctttttgtttggtggaggaattgactttgcctttgttttcggctgacctgctgaaatgttcgtgttcgtgttcactgtatgttcgtgtacacccgctgcatcagcaaatgcaagcacttgtgggatgccacaggtagaccttgggaggaaaacatgacaactctccttgaggagctcaaagttgtgttggagacgtatctatgagcagccagtgggaatcctaacacacaagactcagagaggaggatcggaagttctcatccttctcaaaggatgtcccagagacagtgcacaaactcagtcttaaagcgatggctaggagcttgttagagaaagctaagaatagagccctggaagaatgttaggtctagaatgttagtcttgctaaaccctggttgggggaaccaaaaccaagctgagaaacaatgcccagcagttacaaaaacaaaacaaaacacttagacttgtggtatttaagaaaatgagtgagcacagtggctcacacctgtattccagcactttgggaagccgaggcaggcagatcgcttgaatccaggaatttgaggccagcctgggaaacatgttgaaacgtcacctttataaaaaactagccagccatgtgggacctctggtcccagctacgtgggaggctgaggtgagaggatggcttcagcctgggaggtccaggctgcggttaactgtaatcatgccattgcactccaacctgggtgacagagcgagaccctgtcaaaaaaaaaagagtgaactctttggtatttgtcaaaaaccaattataaaggctcagttaatcattgcagagttacttcattcactttaagctattacgtctttagggagcaggtttgtccatggaactgtttctcagtggtatacatgggagtcacaccacccaccaccatgatctcccaccaccaccaccagcagcaccagcaccacaggcttctctttctgctccttctctgcttctccttctccttctcgtggagaggcagaattcaaggatgaatcaagaggccagaaacaagggacaccaaacctgagctctagggttcagagtaggttggaggagggcctgggaagacgccatgatatgttgaaataaagtgtattcatacctataaggtatatatttttattagaaagcccatggcatcagacttggcctaaagcagcattccatgccaaaaaaaaaaagtatatgtagagatgtggagacacaagagcacagatgtttctggaggaacgtgtgccagttcatggtataaggagtttgatttttatgagcaaatgaatggagtctgcccagagaggcactggctttctggccagaggagaccagccggattttctttatatccgcaaagctgggagttaatacacgcaattgagacgtggctatgtgcccagcagaaaatgcccagcctgcctgtatcatcaggttatgcctattcataatgaccacctgcagttctaaatggacctgcctttggtgttgaggagctttcttaggatgattctccctctgtaaatgtacacactgaagaaactttgctgtgaagtaaccaagtggttgggtccccaaatacaggtttgatttggagtgttttggaacctaataattccactcacacatgaccctcagcttccccttacctttttttttttatcttattcctcttcctaaacattctctctcttcccgctccctaaagaggcaatagcttaaagtgaatgaagtaactttgcaatgatgaacggagtctttataattggtttttgacaaatactatagagttcacccatttttttttaataccacaagtctaagtgttaagatctgggaaaagattactacaaatccataggattatctcatgttgtagagctgggatgagccttagaaattattagaacattaattcattcagtaagagatttttgagtgcccacagtgtagcagacaaattgctgggcccaaaagcggtgagcgatttgttcatggaactgtttcttagtgatagacataagaattattacccaccaccaccatctatcaccactaccaccatcacagtctcctcttcctcctcctcttcctcacatcaccgtcatcatcataacatcatcatcaagatcatattatcatcttcattatcttctgggtgtttactgtgtcttaagctctaggctaaatgatctatatacatatatatatatatagacatttaattaccacaactacaatgattcccattttacagatgaagaaactgagtctcagggtattgaaataacttgatcaatatcacaaagtttgtaagtagcaaaattctgatttgaacctaggtctgtctggtttttataaactaccctattctggataaaattcaggtctcctgccaatttcttttgcaaccttagtagttacattgtgtattttaaccaaaattataggttccgaacagttcagaataattgccactttttgaagtctctattctagctttctattcccatagtgaccatgtcaaagttacaaaatacgcaagagatgaagaaaaatggtgtaattctctacagaggaagagacttgattttgttttttgtttgtttgtttgtttgttttttagtacacattaactgctgaagttaacaagtgtaccttgggtttaatattggagttaacagtctggaactaatacgctttatttatcaggaggaaatgtgttaggttggaattgaatttcccttccctcatttttatactgtatgcttaattttttaaatctaccttgtctgaaaatgattggtacaacagcctcacattctctaacatcctgaagaccttgtagacttccttacttgtttgttgcaactactggggcaagccaaatgaggtgtgtaaagccatgaaaaggcccactctgggccaggtgtggtggctcacgcctgtaatcccagcactttgggaggccaaggtgggtggatcatttgaggtaaggagttcgagaccagcctggccaacatggtgaaaccctgtctctactaaaaatacaaaaattagccaggcgtggtagggcacacctgtagtcccagctactcgggaggctaaggcagcagaatcactcaaacctgggaggtgcaggtggcagtgagccgacattgcgccacagcactccagcctgggtgacagagcaagactccatctcaaaaaaaaaaaaaaaaagaaaagaaaagaaaaagaaaaggctcactctgggctccctctcaaagaggtgcacactcccagaagtggtcacagcattgcctctccaagtatttgctccattgagtaaattcttatacctgttataacaaccgcattgcacttcttaaccttttggagcccctttgtgccattctgggactccactctaggggctgtgatgagatattttggttactctttgtttacatggaccaatcatcctgggctcccctggcccattccctctttctcatttctagatgatgataattgcaaatctcaccttctctgcccaaccctgcaaactccctccccatcctccttctcagctgaaactgccagaagagagcttaggaacactcccactgtcctgtcaactggcctcaacactgccgctggctcttcctgcaccactcccaccccgcccctgccccgccccacaggtgacctgtctgctgtctgcactcaatctaaaggaaccacagatgcactcgcttcacttacctgaggaatcattacagcaggcccctcctttctcccctaaatttttgttctgtattggctgattcctatcatgaacgaaatgtggtcttccttctcttaccttaacacaaacacctcatctcaagtccacatgccctgcctggctcggcctggcttccctgttcccctttgcagcctgaagcagtcttctatctgtaacatctccaggtactcttcttccactctccctaaatccactcccgttaggctaccacgcccagcactctccgaaactcctcttgtcaaggtcagagatgacctccaggttgctaaatgcaacaggcatttctcagaccccaacttattttacctgccagcagcattggacaccattgattcctcctctgccctggatacacttttttctttcttgtcagctcatgggcatctcctttgcaggagggttggccggttctccctcttctccctgacgtttaatattgctgcaagactcaggacttgttcctctccttttcatggctgcacgccctcccttggtgtctccctccagtcttatagttttaaatatcctccatttactgatgattcctaaacatatgtcatcagacaaaccttctctcaaatctctcagatgtctgagagacatttcaattttaaccttaatatctccaagtctcagtccttgatttccccccaaaaccaaaaatacaaaagaaaaaaaatccaccctatccacaacctttctgatgtcagttgatggaaaaatttgtagaacaagctaaggaccttcaagtcatcttttattctactttttctctaacatcccacatccgatccatcaagaaatcctgccagctctgccttcagaacacacgtgcccatcctagcctccacgtgatgtttgggtgcatgaataccatggcagacttggcatcagtccactcggagggttggagggctggactcaagcccagcagcagcaggaaggaccgaggctctactccggcacctcaggtactagctcaggtgcaaggagaaggggatgcttgggtgactggggtggaattttaatgtttctaactttaaaagtctgaattcctcaagtttctcacttatcctcactttgtactccctgaggggaaataattcacccccacaatgttaggtattgtctatatgatgatgagtttcaattctctagctcaaatgctcttccgagctatacacttggagagagagagagaggggtgtgtgtgtgtgtgtgtgtgtgtgtgtctgtgtgtgtgtgcatgtcagtcactggctaatttccatgtccactgcagtatcttacattcacctcacatcctcatgcccagcactacatcatcctcccccaacctcttcacagaccccccgctgcccactgtgcgagcacagccctggccccccgaccctccatgtctcagactctacatgatctgtttactctcctgactcatcattggccatctccccagttttctcttaaactttgcctacgtgaacttctttggattgcttcagaagtccatcttcttttcccccagagtggctcttacataggatgttccttctgtccagcccactcgctctcctctccgcgtccacttgtgatcactcctagtcaccaccctgcatgttatctttttcctttaagttgctccctaattcttgctctgccccacattgactcttctggttttggattctcctatatcctgcactgacccttttgttacataggttaagtataattatttatgaatgtaaactccacaaggatgggactcgcatctctgtttactgtggtatccccagcaccagcaaagtccccagtttgtggccgtccacgaagacttcttgggcattttctcatttgatacttaaacagcctagttttaaagataaggaaacttacaagcatgtgatttcacatagaatggtggaaatcttttctgatcatgtgatttgggggcagggacctgaaggtgaggatcatgcagatgagttctctgggggaaagccttccaggcagggtggaacaaccaacgcaaaggtcttggtgcaggaggctgcttggcatattcatgaacagtgttgagcctgagggagaagagccagagataagatcagagtggaggctgggaccaacacctacaggctctgtggcaatgaagggggcaaagggagtatgggggagaatttagagaagctgagaagttgggtttaacttattggcactgaaggttttagaataacaatgacatggtgcaagcttaggctgatatatcaacttcttgtattatatatactacacatttgttatatgtatgtatttattacagtaaattagaaatcagagattaacacaaatttaaaagatactaaaaattacctgtaacccctctaactgaaaatggccactattaaattttcatagctctccttccagataataacatatattgaataatactaagtgtattaagtaggaaaatattcataacctatacatacatatattctcatggcagtaagtatacatcgtcattatctttttaacatcttaatagtatttcacgatattaatgtgccttaatttgcgccatcttctgatattgaaagtttaggctgtgacaggaaaggaagtggcaggtgtaaaaagccatggtgagtgacaaatcagcaggaggtggtagtgtatagaaatggaacaccagggaagagagcactgtcaaggctgacttgaggatctcaggcctgggcagctggaatggtgattctctattcttgacagggagtcagtttctgtgactggatgaagagtttggagtggaagtctatgagcaataactcggtggaaatgttcgttaggtattgagaactggggatgaagccaggtgagaggttggagccatctggaggaccatggaaagcgtgggttgtggaggtactgctcagagcctctcggagggaagaggggaagagggacacggaggtgtctgaggaagtgtggtcagggaggcaggaggagaacttctaccacgccacgtcaaagtcaaggcaggagaaaatgctctaggcgagttagtgtgctgccgattttgtaacggcagatgtaaatgaaaaaccaccccacggtggccacgcacctcttcctggctcacagccccagggacgtgtttgtgtagacaatagtggtgatcatttgagtcatatttaaattgtttatttctttctgttaaaggtaaactgaggcacaatacaatttttttttttttaaaagcatttatttgagcaaacagtgattcatgaattgggcagctccaaaccagaagtggttctggggttctaccaagggaacaagggagaaggcttttacagaacaaagacagaagcaaagcaactatctgattggttacagttatggagttgccttatttggtcaatcctgttggaaagttcttagttacagaagttagttgggagcttctgactggttagtctttaagtttcacttttctttaatataggcatttatgagaaaaagcccaggtgaagtttttgtttcgttttgttttgctttgcttttgagacggagtctcgctctgtcgcccaggctggagtgcagtggcacaatcttggctcactgcaacctccacctcccgggttcaagcgattctcctgcctcagcctccctagtagctgggattacaggtgcacaccatcacgcctagctaatttttgtatttttagcagagacagggtttccccatattgctcaggctggtcttgaactcctgacctcgtgatctgcccgcctcagcctcccaaagtgttgggattacagatgtgagccaccacgcccggcccaggttaaattttatttatgtttgcaattcacacaaggtcaaggttacttacacttacaaggccaactggctttgtctccttgaggattctttaggccttttaacttacttttaacatcactaaccacactaatttatatggcaaataccctcttattgacactgttgcagactatagtaggggaaaggttaattccagaagcagggtgaaagacgcttacatgcagacagctttccaccctctcctcaccgcatctgtgaccaacagaaagtgtctcctctgtcttaacagaatttgtcactctgctcaggtagctgatgccactgcacctggtgagccacctagctcaacaaacatatttgcttttacagatctgccttttatgaaggcagcctgggctaaaccttggaaatggtttgataagccccatgccctgtgctctgagcaaatcgaagcctcctgcatccttcaaggggtcccctctcctcccgtctcctcccagtatctcttggatgcaggcaggcctggagctgattgacagaagctgctcgctgggcctgattaacttgtctgctagctccaggcagagcttggcctcacagcccatccggctcctgcctcctccccgccccctgcagcatgttcaactttagtctgaatatggtgatagaccatgtggctggcaccagcatctctccactgtctgtgtttgtttacgctcattttcattaatccagccacttgttagcagagagccctctgtgtctctaggatgcggtactagagagactgtaaaattgaagaaaattgcttcctttgaatggaggaaaatatcagctggctggttgatactggaaaagtatatgtttcagaagataaaattggagttagtgcacagggctcaaagcaacttgatttccatatgtgctttatcctcttctcttttgttatgctgaaaaaacagatgggttttttttttaaataaagcttatggggttaggtagaggggggaattcaagtttaaaatggtttgggtatttccactgctttttggaggccacatttttcaatcaaaaccattaagccttagaattgcagagagtaataaagtcccctcgagggcacttggtacagcagcctgtatcccatggccagcagggacttcagggaagtacccaggaagggcaggcttcgtaagagggactgtgttctcccacggctctgagagtgtttggagagcataacagtgatcatttgaagtcattacataaaaatacacactgaagcacatcgttgtaccttaatgaagtccttaagaaataaacaaaatgtaattatggtttacattggtgtaaaccaccagtttattttttctctcttttgttgtcatgctcaaggtcgcacctttccttaagagaagagagcctcagttgtctggcattaggaacccaatcatgtctctgactattttcgtgcagtaaaatctgtccatgccatcactcccattttttctgcctaacacagtttcaacagtatcctgtctgcacggccaggcttatccttaaatgcatcttccccatttctggtctctgagctaagacaattatttgcttaaacttctgcaaaagtttcctattggagttttctataggacctacgggaagaactcaaaagacagtatcatttagcgccagcagcagcggaagcaataattgcaacaggaattgaaaggataacagtagctgcatgaaatatctcagttacttcagttcagtcttcactgaaacccatggaggcaggaattttttttttattatactttaacttttagggtacatgtgcacaacgtgcaggtttgttacatatgtatacatgtgccatgttggtgtgctgcacccattaactcttcatttaacattaggtatatctcctaatgctatccctcccccctccccccaccccacaacagtgctggagaggatgtggaatttttacctttactttagaaataagaaaactatgagtcaaagacactaaatcactttttcaaagttaccaagatggctttagagaatccagggtgttcctgcctcagtgtaccttgcctccccggtctcctcaccacccctactcatggcctctattttgttttttttttgagatggagtctcactctatcgcccaggctggagtgcagtggcacgatctcagctcactgcaacctccgcctccctgattcaagcgattcttccgcttcagcctcctgagtagctgggactacaggtgtgtgccaccacgcccagctaatttttgtatttttagaagagacagggttgcaccatgttggtcaggctggtctcgaactactgacctcgtgatctgcctacctcgaccacctaaagtgctgggattacgggtgtgagccaccatgcccggccactcatggcctctattaccacgttcctggccatattaggttctttggcagctttgtgactttattgctcttctctttttctgaaaataccgttgctcatcacttctctgcttcagaaagtctcattaatcctcatggcttgacccaaaatacattctctctgattttccaaattagaattagttgtgtactccacgataccgcagtagaactttacaaaacttcagtcagagcatcagcttgtgaaccagctagggttggaccaccttggggatgcagcccacttcgcagaggctggatgcacttcctccgtctgaaagcagagagaggtgtgtcttggggcagggcagccgatttcttccacaccacgctggtcccttccagaggtgctgtaggtcctctgcctgtaggtcctctgggcggactctagttcctaactgatggatgatgctgggccccgctgttgatgctgcttaattcataatttggggactcaagtctctgcaggctccactgggccaacttgcttcctgcagagatacatgttcagactctactaattacttttccttggcaaacgttgcatccctgggaaatttaaatacaacttccatctttgttgactccagtttagaccccggccaagactgaaatcgcgtttcaactttatttgtttgcagtatacagagggacaggctcttctttttttgtttttgcttttttgatttagggaaataaatatttgattttgtgtgtatatacgtgtatacgtacatatttttttctcttaagtaaagggatctcatgtgagatgttcatgtttttttcctactctgataagtagacagatattctccaggtcattatacggttgtttccagggctccaaggatctcaagaaataatcctgaagaccccgccgtactcagcccctccatcctcctacctaatagagcagatgacaggatacgccgtgcagcgtgccttgtggccagcctggtctttcttcaaggtcaagctcaaaatcaaagcctggggcaggcggttttctgcctggcaacgcagctcagccccagcagcccacagaccaggatgcaggagtttgttttactttagttccgttccaattaaaagagtctgagagctcaggtgaatcccaatgcactgtagctgtttggcccaagggtgagattctgccgcgtcctctttttagagtgaagcgcattcagaagacccattaattagagactattcatccttcaacacgatgatattcacatgagcactgacaccaccatttattgtctcagttaaattacttcacagagtccttaaccatggtaacctgctagggtctaattaattatcattgacatcttttcaaacatcgatcaccttcttaattaataaaaaagactcacttgatctcttcggtaactgagcaccgtcccctgtgactcatcaatcttttgcccacagcatgtctcacttcacattcaggtgtctgtctgcatctctgtctggctcttgacagcaaacatcttgggggtcacaggtatgttgtagtaattatcatagttccctcataggtcacagtatctggggtgggataaagtctcaataaatattaactgattgaatgattcagcaaatgggcaaattgagtctccagagaagaggcctctgggaactgaatttttggttaattgagggctggccaggctctttattgtaactcttcgtgttttaagaaagtagacacacgtgggcggggcgggacgcagtagctcacgcaagcctgtaatcccagcactttgggaggccgaggctggcggatcatgaggtcaggagatcgagaccatcctggctgacacagtgaaaccccgtctctactaaaaatacaaaaaaagttagccgggcgtggtggcgggtgcctgtagtcccagctactcgggaggcagtgagccaagattgcgtcactgcactccagcctgggtgattgatagagcgagactctgtctcaaaaaaaaaaagaaagcagacacacccttgtaataagaaacgcacatctgattctattttcttgctttaactgggactctctaacagatgaaagagatagctcctgctactcctcatactagatgtgttctccatcgtaagtttgatacttgccacttattgatcatgtgcagaatgtgccagacatgatgctaagttcttaatcacttagcatcccgtgaaagacaggcgaggccatcgtctctacacagcccacatatttacaaatcttccaactggatggggccatccagaaacacaggcatgaagctatgtcctatggaaggtactgtggccttttaaatatttggggtgtgatatcatcctggtctcttttccacctaaatccccgtccctcctccatcctccatcctgtgcatcactgggacctcatgacgtgtttatctctcagcgatactttgctaccagcactgcatcttctctgttttccaaaatacactaacacaaacatgcttcataacagacatttacaaaaagtgacaggatgacaaaggagaactgtgggtaccacagaagatgaagcaacaccgatatgaacagcacggcttgctcttcttaaagcccctagacattcttgcttaagagaacctttccttgactgcccctttttctcttgtttatggggtcttccaacaactgcatggcctggttgtgctgcggttgcttctatcacagaacttttccgtagcccccattgccctaaactgttgccaataaagaccaagttgggattcagggatatcgaagtgaatcagagttctcttcaaacttagtgtgaatctcatgttcacatttaaaatgctttaggggcccttttgtgcagggctgacacccatatcctatgctcccttcgcaagctgagtatttgcaggacgctgttctgagattggtgtagacctttctaatatccggcactttgcagttgaaatggaattcgtgctttgtggtgtcttttctcatatctctttagtgtaaaagtggtagaaatgtgtagaaatagatatagcatctggatattgtgatgctgagcaggttctgggcttttaaacccagatttccaaaataagtgccaacctcacatctgatgcttctgccgagtgctccctggaacccagcctagaccgtctcttgggtcaggatcttctgttctctctcaagaccccttattcattccccctcttctctgaatattttgggatcctctgaaatgtcctccctccagaaaaaaaaacaggtgatagctctcagattccagcaatttatgaagcagattaatctagctgtgctggtcaggcctctctcctgtgctcctgcctcaggtacctttctcaaggatcaacaaaaagccaaatgcaggaatttccccaaacgaaagatacgtttctggaatttctaccctttgcgaggcaaggaaccgacatgtgcattcattttcttaacttctcccagatcacattcttacacaggacaacccaaagaagggaaagatggaataaacctcggaagttcaaagtagcagaatgtttcttatttacaccagtgttacagatcaggggccctagaatcagagaagttaagtcacttaccttaggccacacagctaataggtgacagagctagtctttactttgaaaatgcttctgacaattctgaaaacatgcccaaagtccagtggaaagttatgttcactaaatacaacggtaccaattaagtcttcatagggttgaacttgaatctgcaatggaaatctggaagtatctgtgaaggatgagacaacacccccaggtgtctcttcccccggctccctcgtgctctctcaagatcagcccagctcattagtgcagcccgtggctacatccaaagcacgcagccctccttgctgcagtcttttgcaagccaggcatcctgaaggtcacagcagaagtgctgtggggtaaaggatgagtttgtcagcagtgccccgtggctgcctggggctctgaagggcagccagatggagtgtgagctttgccttttccaccagatgttatttacttatttttgctgttagcttctcactcccatctcaaacacctctgggcaccaaatacttgaaagtagtttgtgatccgcaaagacaaattcctaataaaagtctgaaaataaaataatgttgctggagaattatttgggatacttaaaagtgttgtgtgttgtatctaacgtgttgctggtgttttccatacatccatgctagctgcttgggaattgccgagttctgagtcaggaattttaatgggcacatttattcagaccctgagcctctgctgcttagttctcaccagtgataacatagtttacagagtgacagccggagaccaggaatgaagctttataagtcattttaattatttgatattacttgtaagttgccgaaggaaggagactcctgtatgactatactgtaggtgtctatttgcgacacaccagtgaacacgcacgtgcgatatacaaaggacaaaatgcatgtgtgatggtcagcgactgagaatgcccctttctggctgacatcagaggggtgcatggcaacaaaatgtcatcccaatctctcatgggatgttttcttttccaactttcttctcaatggcttctgacattaaaataggtttttactgaatataaagtacttatgttcctcaataaaacccaaattgttgggttttaaaaacttaatgttggattaagatctcctaataagcaaggttaaacaaacaagggggttggaaataaaattagggagtgccaatttaccagctgctgtgcgttagcaacaatggccctgttagcgctcccccaggttcttcattaagctcggaaaatccttactccctgattgctcagatcccacagatgagcctagaagaaagtattaaatgtctaagaaaagacacaacatattcaagtctaaaaagatgtttctatttcactttgaggctcaagtaaacccatcccccgccccttgttctcttcccatcatcttcctttgccattggagcctacaattcgtccagaatcctttcctcctccctcttttgaatcagtccttgagacagcataaaagaagaacaaaagctccaccttatcccatcgccatccacctgtcttacatacttgaagaacaggagaagataaataagatggcccagcatggtcattttctaatttttatggagggacttgaatttgaaaccgacaccactgactgtgatcatgcccccagcatacgaaggaggattttcctttgggctcccaggcagatttaggcaagttcctcttctctgcctgccgtgacctttagaaatcatccactaatgtgtcttttcatgacttcccttccagcgttaagttccaggaacttaatctctttaagtgatttctgtccaagctcagtagctcaaggatcccataatgttaccaaaaaagactaagatctccatggttctagctgcatccaacaatgtaaacaggtaaagtagcatccttggagcatcttttattcactttataaatatgataaaagtgctgctaggtgcctaaagctctgatttgttagatgacttgggatcacaaaggcaaataagacaagctttgtaccttgtatttagagcagaaggtatattttaaatgttaaaagccatcgctttatttttatttgattatgctgggggctgaatctgtaacaccttgtatagcacccaggaagtattagttaagtgaatgcatgcagacgcacaccacatggttccagaaaggattctgggcaactcagtgcaaacatcagatagcaatatcccaaatcccaacaactgcaacagaaagaaaataggagaaaagatgagatttgtgcccgcagtgcatgttgatttaataggaatttcaaaagaaaaaaggacgtctgtggccaggtatatatccaaagcctgctttctccttctcgcctcacctctgctggcttctggagctcacactcgttcacctcgtccttccctcgttccacccattccctattctggtgggataccgcaccgggtgttatgagtacatcagctcatttgatattcacaaccattcctgctggctggtggtatctccattttacatatgaggaaactgaaggttagaaaggctaatgaggatcacaagtctcatggctagtgtcataagagagcagatatgacttcaggcttgtctgtctccaaaagccttcgatgtggaccctacaccatcctacaaggaggtggttctctaatccgggatgaagctcttgttcttcctgtttttccttttcctcaacatatgaggatttgttctgaagatcagcagtaaaatctcactgaagggttgaggcttgttttaaacgagtccagaactaagatgtaacccaaatagaaaaacagtcagtaaaaatccacgaagctcccgcatccctcttcttaaacatggcccagtgacccccgtgtgcgggttaaactcgagattcctttagaagatcgtgcttcttatataactaggactaatgaaagcagcctggaaatgagtgcacagtttgatatgggacccatcaaagatgtcattcagcctgaggataatgacccccaaggctgctgcaagagccatgtttgagctagagccagatctccttgaagtttatgcttcaataacttcgttaagcctccttggtgcttttgggtcaagcatgactttagtaaatgaattatacgttggataagggtcattttgtaagtgaaccaaatgatgataggaaagtcattctctgcccatacttatggtgtcatctgtaagcacagacctgcaactttccgtggttcagtgagactgagaccctgggtaggtgcactcatcacaggcctcacagggagattttatttaaattgacacaaagaattgaggattggtggcccatcgttttatttgaagatgtagacagcaaaactaaaatatttggatttcttttgttctgtaaaagatttatttttatgttttgaatgcctaaagagagaaaatagttattgtatgatgatggtcatcttacataaatgaaaataccatttaatgacatgaatcttattcattctaagaaattaaaatgcctgtaatcattcatttatattgttgccttgttatttggctttcgtgaactgtgtaaaaagttgtgaatttttaaagaattcaagagcaggattccgtttctggaattcaatatcggtcacactgtgattgcgaaacctctgtatacggatgcaggcagggagttttgttttgatttggtttggtttatgtgtgagcaaaatgtgtcatagatctgtagaaactatccaattttatagatcctttcaaacatggagttgccagacttctcctaggaattgtagcaggtaagataagccaagaagtaagaggaccatctgatagttcttatcttacttagatggaaagtggaaagctcatggaaactagaaatttttgtgtgtgttggttcttatttattaaaagatatattgccggatattgtggcttacacctgtaatcccagccctttgggaggccaaagccgaaacatcgcttaaactcaggagtttgagaccagtctgggcaataaagtgagaaatcatttctacaaaaaatttgtaaaaattagccaagcctggtggtggacacctgtagtcccagctactcaggaggctgaggcaggaggatcacttgagcctgcgagggacaggctgtggtgggctgacatcgcaccactgcactccaccctaggcaacagagaaggaccctgtctcaaaaaaatatatattatacatattttttattatatataaatatataatatatgataacatatatttatatatatatgtatatcacttgtaagcctcagtagtttaatattactaacaaacttcacagtgacacatcacacaaatgatctcagcatcctagaacttaaaatctaggatgaatatgttcttataatttttgtttctttctatatttcagataaaactcagatacctaaatttcatgatagctttctccctgggaaattatattctcttcttattgcaagcaccacattattgatttccctgatacctcattaccaagactcttttctgcaagagaaaagacgctgagtactttatccaagtttcacatcaggcccagtgatccccaacccactgtctttccatcaatttgcctcctccaagtcaaccaaatgcattcagttaataattgaaaaaatggtataaaaataaatcaggcatgtatagacgttgtcctcaggtacttgcagattaagggagggagtcaggtaaatggttaaagacataacaaagcatgggtgctttctcgagatacagacagaggagggagaatacagagaaatggcagcttcctgctgtaggagcttagagagagtctcgtggaggtgacatttgaaccaaagtaacatttgcacataactaggacattgccatgtagaggcgtctggtatgaggagggagcagggaatttctctaaatattgcaggtaaaaaggtttaggaaaagagttgtggcatatccagaaactgatcagaatatggatttggcttaagcctgcaacattcagtatctggtaggaaatggggccatgagtgtgaggagaagacagaccctcagggcgtttctgcaggcccctctctagcagctggggccatggtgggctctgagtgatgagagctttttatttcttaaatgatgagggtggagtgtagatagtgggctaggagaaagacatgtatatgtgtttggctttggggggtttgttgtggtttttttttttttgttgttgttgttgtttgagacagagtcttgctcagttgcccaggctaaagtgcagtggctcactgcaacctccacttcccaggttcaaacaattctcatgcctcagcctcctgagtagctgggactacaggcatgcgccaccatgcccggctaatttttgtatttttagtagacactggatttccccatgttggccaggctggtctccaactcctgacctcaagtgatccatccaccttgatctcccaaagtgctgggattacaggtgtgagccactgcggccggcctgtatatatgttttaatgagtcactttctacataaaaagttatttgcaggaaccagtgcggggaggtaagaatgacttaggcaaatctccttcttttaataagcttggagtccaacaacaagtgggcgagtcacaaacaccaacagctgtgtgtgtacccagatgcaggaagggacacagaaggaaaaagacacactgaacatttggcacagcagtgcattgagccagggactgtcagagctgagtgctgtgggcctctggtaatgaccattaaacaaacacctgccagaaagaacttctcctccactgggattcaacaatagggaatacctcatccagtctacctattcgtaatagacaatttagtaggcaaaatcttaaattttcataaagaagaatatcttaagagttggaggtttcacacatattgtatatcttaattttcaaggagatgcctatgatatgtttctaagatctttttttttcctctctggaataaatactagtgaacttaatttatttcaagaagaatacagatgcacctcttaaacatactacatacactccatagtctcagaatccaagactgcaaatctcctgtctaaaaggaatgagttaatttttgaaaagcagagtgaagatgttatgacataaaagctataaaaattcacttaatttaattaacttgacccgaaggggagctatgtgagtccagagacttaagattttttttactatgtgagaatatcccattaccaagtgtcatatatttatcccataattttcagcatgttttactgtggggttactcctcaatggcaaatgttccctgagcacaatgaatggcatgcgcccgtggctagaccccacaagaaagtcaagctcctttgaacccacagtgtgctgggggtcttcgactctctggaagaggttttgtgaaggggcctcttcaacagaaaggggaaggagtccttttggatctgccccatcgttaccatccagcctgctgtggaacaaaggagaacagacctaacgcctgtgcttggaagaacttggaaatgtgtgctgggaaacaggatcgaggccttccttagtgtcacttcataacatagaagtgttcacgtgacacctgcttgtttagatgactggtgtagctcaatcttccatgattacagctacagaattttggatatgcttttattgtttagcctagaatacatttagagaatataaaaaatttactcccatctttaaggaggttacattctggctcatccattcactcatgcagcattgtgttgaggacctactatgtgacagggactatttcagccactgggataaaaaggtaaagaaagcaaactccctccctccccccatgaaccattgtaggttaaaatagcccagtggtatttttcagagctcaataccaggcagaactggatgtaaccttcacaaacttggaattccatctcacatctgacagactaaaaaactaaaatcactcaagtaacctgcccaattagagtctcttctagtttgtactataccttcaacctggagttgagactgaggaaggcggaggaaggtgagaagaagggagtgttggtcaatcctcagaaaaagaactaggacaggctgggcatggtggctcatgcctgtaatctcagcactttgggaggcccagttggttggatcacttgaggtcaggagtttgaaaccagcctggccaacatggtgaaacccccatctctactaaaaatacaaaaattagcaggatgtggtggcgggcatctgtaatcccagctacttgggaggttgaggcaggacaatcatttgaactcgggaggtagaggttgcagtaagccaggattaaaccactgcactccagcctgggagacagagtgagactccatctccaaaaaaagaaaaaaaaaaagaaaagaaaaaagagctaggataaattagatcatcattcacagcagcatattcacaatagtatcaaataaaaaattttgaaaatagaataaatgtatgcccattttttaaaattggcatgcatttcctgaatatgcttagaggaaaaagcctgggaaggaataaaacaaagggtcgtcaatatttatcttctaggatcaggcatgctttttttctttcatctcacttatctccttacagcatccctgacaactggacttacctgttttatctttataccagaaaccagcccactctaccaggccatgcaaggtctttcctgctcagcaggatgatgggggaggacgcgttgtgtctctatcatggcaatcagaagaaggagaagatattctgtcatcagggaaggggtgaaaccgagcatgggagagaataatatcagaggcagttgcctgcttcatagatagttacagaaaaacatctgaactgacatggtgcttacatgagattgccacagttgatacagctcagaatacagccttttgaaaagtctaagcttagaagcagtcgagaacacaaaaggaaagaaaggagagtgaggtacttggactgagcgaggtggaaggtaatagaatcccaaataattgggttaaccaaatacgcaatgaattttcctcacatacaagcaatcagagatagaccatctttttattattttttattttattttttgagatggagtctcgctctctcacctaggctggagcgcagtggcatgatctcgggttactgcaacctccacctcccaggttcaagcgattctctgcctcagcttcctgagtagctgggactacaggcacatgccaccacacctgattaatttttgtatttttagtagagatggggtttcaccatgttggccaggctggtctcgaactcctgacctcaagtcatccaccctcctcagcctcccaaagtgctgagattacaggcgtgagccaccaagcccagccagatagaccatctattatggctagtgtcattgccctcaaatatcaaggacccaggcttctagagtagggtgttccaacctcagcactattgacattcggaccagatgattctttgttgcagcagctgccctgtgcactgtaggatacatgcctgccctctacccactcaatgccagcagcacccaccacctacgctgtaaaaatcagaaagtctccagacattcccaaatgtcccctgagagggcaaaatcagcccttgttgagaaattactattctatatccctgctctgccatcagtaacatatggcttttatctttagattcacaaaagaaaagtaggcaggtgagtttgttggcagtcacagctctacagaagccttgtggtagctttcagctcacatctgtctcgtggccctgagcttggccacgtgactaaccctttgttacttgcacagaagtcggggaggagaatatttttatctggacatattgaatccctagccaacattagggttctgaggaggacagaatgggtttggggcaggtgactggcaggctctacaagaagacattagagaagaaaggagtaaaacagatatttcactgacctcaatgataaggcatttcatggatacaaaaggagggcccccctgcggtacaaagcatggccattctagcactgcccccctgccttctaggagcacagagtgtctgtgagcactgcagcagcccattcccaaagaaactgggctcctgttcatattccacgaggcaagtcttagaccataggtgtgcctgcagtcactccaaattgcatgtccctgcagtgtgaggccaacattaagtcttgagatggagcagcgttaattggccattgcttaagagtctcttcattttctcatctcatgggttttaaatattttttaatgttttataggtcctttaggacaccacaccttttcatttattttagtatattttggttaaaaaaattctgtgatgtttaaaattagggaataataaaaaaattccctatgaaacctcacccttagcttgaagaagtaacaagtcatagtgaatctctgtttcctctatatccccaccacccaccaacccccccagatcccatacactatatcattccatctacagatatttcagtatgtgtgtgggggtcctaaagacaaccaggtttcatgagtcactgggaggactcataagagtcagcatttagacacaattacagctgtgagttattatcgtgaaaggatacagaacaaaattatcaaaaggaaaaggcacatggggtgacatccagaggaaaccaggcacaaacatctaagggccctctctaaacacaatacatgcttagtgcccctggcgagttgtatagcatgggcatgggcggactgtcatctaccagagaacctcactagagactcagttcccgtgggttttataggtggctcgtcacactacattctagactttcagaaggaaagcaggtgaccagccaaagccacagggaacaaaatagtttaggcacagaaagccactttgatcagtgatcagtttgaagaaaaatgtccaggaattattatagatagtggtgatggttgcacagctgtgtgaccattctaaaaaacattgaattgcacactgtaaaatagttaaaatgatgacttttgttatgggaattttgtctaagagaaatacatcccagttggcaccatttctataaaaaggaatagtgagagataaagcttataatatggtttcgctgtgtcactacccaaatctcattttgaatggtaattcccacaatttccatgtgttgtggcaggaacctggtgggaggtgactgaattatgggggcggatctttcctgcgttgttctcctgatagcgaatgagtctcatgagatctgatggttttaaaaaggggagtttccttgcaccagttctgttctcttgaccgctgccatatgagacatgccttttaccttccaccaggattgtgaggcctccccagccacgtggaactgtaagtccaataaacctctttcttttgtcaactgcgcagtcttgggtatgtctttatcagcagcctgaaaatggactaatacagtaaattggtaccagtagagtggggcactgctgaaaagatccctgaaaatgtggaaatgactttggaactgggtaacaggcagaggttggaacagtttggagagctcagaagaaggaaaatgtgggaaagtttggaacttcctagagacttgttgaatgttgaatggcttttcccaaaatgctgatagtgctatggacaatgaaatccaggctgaggtggtctcagacagagatgagaaactagttgggaactgcagcaaagatgacttttgttatgttttagcaatgagactggtggcattttgcccctgccctagagatttgtggaactttgaacttgagagagatgatttaggttatctgcttgaagagatttctaagtagcaaggcattcaagaggtgacctgggtgctattaaaggcattcagttttataagggaagcagagcatgaaagtttggacaatttgcagtctgacaacatgatagaaaaaaaaaatcccattttctgaggtgaaattcaagccagctgcagacatttgcataagtaatgaggagtaaaatgttaattcccaagatcctggggaaaaatgtctccaggccatgtcagagtcatcacagcagcccctctcatcacagacctggaagcctaggaggacaaagtggtttggtggactgggcccagggttcatgtgctgtgtgcagcctagggacttggtgccctgtgtcccagtgactccagctgtggctgaaatggcccaagttagagtttgggctgtagcttcagagggtgcaagccccaagtcttggctgcttccacatggtattgagcctgtgggtgcacagaagtcaagaattggggtttgggaacctctgcctagatttcagaagatgtatggaaacacctggatgcccaggcagaagtttgctgcaggggtggggccctcatggagaacctctgctagggcagtgtggaaggaaaatgtggggttggagccccgacacagaatccctactggggcactgcctagcggagctataagaagagggccactgttctccagaccccagaatggtagatcccttgaaagcttgcaccacacatgtttgaaaagctacagacactcaaggccagtccatgaaagcagcctgaagggaggctgtcccctgcagagccacaggagtggagctgcccaaaaccataagaacccacctcttgcatcaacatgaccgaaatgtgagacatggagtcaaaaaagatcattttggagctttaagattttactgccctgctagattttggacttgcatgggtcctgtagccccttggttttggccaatttctcacatttggaatggccgtatttacccaatgcctgtacccccattgtatttaggaagtaactaacttgcttttgattttacacgctaatagacagaagggacttgccttgtctcatatgagacattggactgtggactttggagttaatgctgaaatgagttaagactttgggggactgctgggaaggcatgattggttttgaaatgtgagcacatgagatttgggaggggctaggggtggaatgatatgatttggctctgtccccacccaaatctcatcttgaattgtaattcccacaatccccatgtgtcatgggaggaacttagtgggaggtgatgaattatgggggtgggtctttcctgcgctgttctagtgatagcaaataagtctcatgggatctgagggttttaaaaaggggagtttccctgcaccagctctcttctcttgtctgctgccatgtgagacgtgcctttcaccttctgctgtgactgtgaggcctccccagccacatggaactgtaagtccaataaaccacctactttttaaaattgcccagtctcgagtatgtctttatcagcagtgtgaaaatggactaatacaacttatgagttgaatttggggtgaatttacattatattgaatgtcaggtaaggagactgaactctattttgtagttcgtaggaaggccagcctagggagttttcatggagggaaaagttaatggagactgctctgttgacaggatgtaaatagcagctgggaaggaaaatgacaacatgcaaaagagtcttttaaagactctagtgaaaatgtttcacatgcctgtgactcagttctgatgatggctgtgatgctcatcatcaaaaaacttgaacttgtcttttaaggtctctatctggtcaacagcagaataacggctaccatggacggttctatgtgtggtcctggatttcctaagaattctcctgatccttgcttcctctgtttctgctctagaagggaaaattggagatcagagagttgaagctacaccttgcaatacagtacagcctttatttacactattaaaaccccttggccaaatggacaaagtgacaggcttagccctttgtatgtttgtccttatatttgcttattcaacaagtattcacagagcatcttcacttgccaggccaggtgattcataaggaaacagagcctcaaggtaaaatccaaagagcatgtggtttgaagccaatagacaggtactccagtcccaggttccatgcttactacccaattgattgctgcctctcagccattcctttcttcacctacacgatgtacctgaccaggcttttcttatgtaactactggaggcaaggtgggctctcttgactgaaagcactctgggaacacacaattttggccaccataaatgacattaaagaatacaacttttgctttagaatctgcgattattgtttgactttagctaagtaagcattttgtcaaatctaacagcaaaagcttctcagtaaaggagcatttcaagaaacctgtgaccctcatagccacaacatttaagatcagcatcaaatattttgtgtaaaggttccacagatgtttgattttttggggtaaggaaactgaggcttacagatgtttttgagacttaaagaattgacacgtcagtctctaaatgaaaaactgcgattaaaacccaatgcttctgcatcaggaggactagctaatggttgctgggcttaatatctgggtaatgggttgatctgtgcagcaaatcaccatggcacatgtttacccatgtaacaaagctgcacatcctgcacatgtaccctgaaacttaaaagttgatgaaaaaaaaccaatgttcctgatttatagataagtaataaaaacaacaaagtatccttttagctgaatgatccctgcttgctaacattgatgaatttagaaatgtgtcttcagttgacctctactcactattatttttaattagttttcttaacagccttaatagtgtttagagcattttatgaaacagtgccctctagtggctaaggatacacttttaaattgcaataacaggtgctatttttagctagctggagaattgatggcgaggctggcatttaaagagatgtattatcttgtggcagatgtgtatattgtacatgtgtagcaaataagcatgaagacagttactgtctggcttgttaactaggtgtatgatttcttgatcaccgacctattaaatcacttattaatatataatcttatcgtgagtgtaaatttagctgcctgtcatttataataacattagcgatgtgacgtatgatcatttgagcaagagcactgctttctgccaaagccaagagcctcaataattatttttaaactgtagttaggtatgatttaaaagagatgtgagtacaagaatagataactcaaggatcaacgtatgggacctaatttttatgaaaaattactcctgtctcattcttcttttcttgtccaacagatcattacaacccaaaagctcaataccatattcctcaaaatgcaaattaaatactgcctctcaaaatagcctttcttaactaaaaatatccaagtttatcttttacaaatttaggcagtttttggttaaaaagacaaaacggtaatggaaaatatacagtatcagggtgttttttttttttgctgtggaatgctattaaaattacatgtttttgaaacttgtcgtttgtggttttaaatcctcaatcatgcattacctaatatatgcatatctgggtccatgcagtcaaagttaccatgttgaaagagattttgcagtttaggaaagtaaggatcataaatgtttagtgaattaagctgacaaaaactattccattttgtaattgcagaatcagaactaggagactgtctcttgactacctggaatgtatgatttacacttgtgttctggacagcagcatctggaaagtctaaatactgtagtctcttcagagacttccaactcagattcctgggattccagagctggcaggatcccctgtagtctggcacagacctctcagcccatactaatccttggcttaattttattctgaaagactttttaaaataaactttttatgttttagaatagatttacatatatagcaaagttgcaaaggtagtacagaaagtttccacatgccccaaacccattttcccctattattatcatcttatatattatgcaacgtttgacacaatgaattaatagtattgatataatgcatcactgttagacaaaatttatgcttaattcagattttcttagctttcacctaatgtcccctttatctcccaaggatcccatccgggacaccgcagtgcatctctttcagttcctcttgctgtgacagcttcgcagaagttcctgtttcttgatttgggtgaccttgacaaaagggtacttgaggaacatgggtcacgtcttttatagaatattcttcaattgcatcatttctgttttgttttgtttcattttccctcctaagtagactgggtttatagggctttgggaggaagactacagaagtaaaatgcctttctcatcacatatctaaggaacaggctatcaacatgatttatggccattggtgttgaccttgatcacctggctaaagtcgtacttgtcattttctctactgtaactacatttttttacccctctttctatactgtgctctttggaaggaagtcactatgcatagccctcacttggagtggaaggcaatgctctttcttcttgagagcagggtatctgtagaaattacctggaattcttccatatggaagatttgtctactctcccccatttatttatatttatttatctataaattatgtatttattatttatttattgaatcatttattaatatcagtatagacttagagatacttatttaagactgttggaagtcattgtttaattgccaagatttgaaaaagttgattttgacaatgtttgcaatctcattgcttttctggaagagatttttggagatcttaactctgctatttggatgtagctcctttttttgtaggattttacacacagttttttttttctcagtttttgttgtgttcagaatggcctgaactctgacacagttgatattggatgatattcttatccctttcaatgctctcaagaattttcagtaaagattttttaagtttcacaattttttgtgctaccaggagaaatgtgtctttagagggtgactattgaatatatagaaacccacattcctgagatttttttgtgtttaatggtatatttcataataatacaactatcttaaaaagaatcacattggcatatttactctgcattattcaaatggctaatgctttgagaaggaacatcctctttataataaaatgagtgctgtcttgtttggcttatttagtatcaaattaatgtgatactcagtgtttcattaagttcctccaaataaccaattttaaagcaacttcttcattctttcatggatataatgctaaaggcgtaaaaagatgatgacccatattatctgaaagagaaaaacatgatttctcctttctctcttaaaattaagatctatatttatgatagcaaaagtcaggtgcttctctccccaccttttagaagctgcttagtgtgatcaggggataactacagagaagcgctatcaaacatttctttctgcactttcagttaggaggatgatgaatgcatacatacacattttccctttctagtagcaatagattaacactgttgggaataattcccctagaaagttttccgagagcctggaaatttcacatcatacttttctagccctgggtcactgtgagtttgccaaagcctccagcagatagataaattggtttccaagtgaacaaagtatattagtcaatctcctgaggcattttttctttgatggccattgagtgtgttaagcagcaactgtatgcccttcataataaaaagcactttaagttgagtgatggaaggctcttgatacttgtggaatgacagagaagttttgaagaaatgaacattagtgcaagtagacaatatttagaaagcataatcaaataaagagttttaagaaaccataatttttttttttactttaagttctgggataaatgtgcagaatgtgcatgtttgttacataggtttacatgtgccatagtggtttgctgcacccatcaacccgtcatctatgttttaagccctgcatgcattaggcatttgtcctaatgctctccctccccttgctccccgccctgatatgccccagtaagaaaccataataagttttaagtcaaagtgagatggaaaatacagagaagggttagtctttgaagactttggagaggtgatttgaaaatcagatgttaaaggaatgcatgggcataaattagcaggacattccaaaccagggctttgatgtgaacataagtcagttatgtgaggaagcagcaggcaagagcaggactggagagggtttgatgtcatctcaccaatcatccacccaataaagaaatctctcagcaacccctggcctgtggtcagccaatctgtgtctgaatgtatcgatcaagtaataatagttcagtgctcttagtgaggaagccagtgatgattgttacatggctctataatattaagataaaatttgtccccagaatgttctatgcttgggttcaattattccttttggagcaactcagaatcaatctaatattttggggaagtgacagtttttcagatcttggaggaagaacttattattaatctctctcccccattcaacttaattgaaagagtctccgattagaaatttgagaaaagatgttctagccccaactctgctatgtattatttgctttgtaagcaaagaacagttaaactgtctcaactatatatagcgtctatttccctctgttccttccctatccagggcttggctctatgaaaagcaactcgaactcttgccttccagcttgggatactgctccaagatagcccccctttagtgaactcctgtctcctatgcagttccatcttgttatcttatacctggattctccatctctgcccagacactacactaatttggatagttttatttctttctcacgttgcaattaatgaggatgagcctggaggtgggggttcctccatggagtccttcagggactggggttccctccagctggtgactgtggtatctataagggctcaaattcctccatcggatactctgtatcttgatggcagactcaagaagagaatggtgaggctgtcacaggaagttttcaggggctgggcatgaaagaggtatgcatctcttctgcatatatttcccattaattcacagtcagtcacttgaccccatctaactgccagagagcaggggaaatgtagcctagttgagtgcctaggaggaaaaagaccaaatgtagaaccagtgcatgtcacttctgcctccacttgtgctagaattcaggcacacagtccccaactaacctcagaggaatttggaaaatgtagtctggttgaaggctaagaaagaaaaggcactaattagactttccaagcttatcagctttagagaagagaaaatagcatagattttctatgttatggagtaaagttgtataatataataatgcatgtgaaaatgcttataatctggtaatgtggcataaaaatgaatgttaatatctttttttacaaataattctggacaattagacagccatgtgcaaaataatgaagttggacccttacctcacaccatagataaaaattaactcaaaatggatcaaaaacctaaatgtaagagctaaaactaaataatttttaggagaaaacagagggataaagctttataactttggatttggcaagattcttagatatagtacaaaaagcaaaaacaacaaaagaaaaaatagataaactgaagtttatcaaaattaaaagcttttgtgtttcaaaggataccatgaagaaagggaaaaggcaatctatcaagtgggagaaaatatttacaaataatttacctgttgaggaacttatatccagactatataagaatgcttaaacccaataataaaaagacaattattccaatttaaaaatgggcacaaaatctgaggagacatatctccaagaaagatttacaaatagcaatatgtacatgaaaagatatttgacgtcatcgttcagcaggaaaatgcaaatcaaaagcacaatgagacactactcccctcttcctagaatggctacagtaaaaagtcagataacaagtgttggtgagaatttggaaaaaacagaaccttcacgtcctgctggtggtaatggaaaatggtgtaaccactttggaaaatagctgggcattttcccagacaaataaacatagagttatcctttgacccaacaatttcattcccagctatatacccaagaaaaatgaaaacatataaccatatacaactaattacactaatgtttgtaataatattcataatagccaaaaagtgcaaacaacccaaatgtacatttgtgtaatggaacattatttggccataaaaagcaataaaatactgattcctgctacatgctacgtactgattaagtttgaaaactgtaagacagtcacaaatgactacaatatacatgattccttttatatgaactattcagagcagagaactctatacagacagaaaatgggatagtggttgcttagaatgggggtgaggggcatgggggcaaagaaagtgatagatcaaagttaagggattcctttttgagattctgagaatattctaaaattaattatgatggtgggtgcacatgtctgtgaatacgttaaagaccattaaattgtgcactttaaattgatgaattgtatggtgcgaattctatctcaatgaagctgttaaaaatgaaaggtaatatatgcattattgttaataagatactggcctacccagatgaaagactgtgcaacactcatggcaggtccttagaaaccaagttctgaccactcaaccatgagaaatactaatgaggaagaaatagaacaagcatctccagcaaccagtgtactagtctggacagctttctgatgatcttgactttaagaaaaatgtatatacaaatggagctaacctcagaacttaaaaatcatgccaagatgaccaagatccaagatgatgtaaagcttgtaagaagtgtaaagggaccaggcacggtggctcatgcctgtaatcccagcaccttgggaggctgaggcaggtggatcatgaggtcaggagttcaagaccagcctggccaacatagtgaaaccccatctctattaaaaatacaaaaaattagccgggtgtgatagcaggtgcctgtaatcccagcgacttgggaggatgaagcaggagaatcgcttgaacctgggaggtggaggttacaatgagctgagatcacgccattgcactccagcccaggtgacagcccaggtgtctcaaaaaaaaaaaaaatagtgtaaagggcattgaacagaactgccaggtaatattggagcaagtaagagggtaaggaggttgaacaactctgaatacactaaaaaccactaaattatatacctaactgggtgaatttatttgtatgtgaattatatcttgataaagcatgtgcttgctcttgctctcactctcgtgctctctctctctctctctatgactctcttacacatacacacacacatgcacacacacacacacacacacacacacacacacacagagagagagagagcaaggaaaagatagaccctggcgtggaggaggtatgcaggataaccatgcagtaaatattcttgcatgttctccagtaaggaatgtatttttcaaaattgaaaaggaaaattcgatatcactttcttaggaagggagggaagattgttcaggaaatagtgagaacaccgagctgctcagggagattcacctcaatctaaagtaaatttgagatgggataacataaaaataactaggtttaaggtactaggacaaaacatctagcatgcattatctcttttaattgctcagtaacccagtgaagtaggtaatatcattatcacccattcagagaggttaagtaacttattcttagtcatgcctgtagacaggatgaacaccagtttgaaaaaccctctctctggctctgggggcaaggtgaaagcccacgccatgtgtttgagaattcagcgcaggtaaagaaatgtttttttgcattggtgatattttatttagtagtaacactttattcctaaggcgtactagttgacttgtcaatgaaattacagaaccattgtaaataatctgtagaaatttgcaagcaaatgagaaagcagctgaaagactgggaaaaagagatgattgttttagttgtcaaaaaaggtaaatctataggactagttcataactggcaaaattctagagccatttaataaatacaagtatgtcctgtaaagcggtttgcatcctggtaacacctaattgtaagccatacaaatactccattttcctaacttatttctagagaatcaattatgatcttaccatagtgttatcttaacagcttttatactttcaaatgaaatggatttattcaaacattagttggtgatatactttttatcatgctgtaaatgatcctaatagaatttgttaaaacatttaagttacgagtgaagcacagttttctagatgtgtgctggactaacatttgccataaactatcacataatcagttccttgattctttatggacctgaagcctacttacataaaattggtctagtaactaatgataaagattaaataaaagtcattgaggtcattgacagaaggctatgttttcctctaaaatcatggcactcaattcataaacattattcatttttcttctaacttgtatatacttttagatgtaattgtgtttcaattttgattgcccagctaatcggaaaagctttaaacctcttaaacagtttctttataaaagcataatgacgtatataatggctttcagataatcctgtcacagaaatgattatttttctctattcctggtgaaccaaagtgcccccatgtgcttctacgtgtaatgttatataaagcactttgaagcacgctgtattatttttcatgacagtatcattgataattctaatggtaatttttccttcacacttggtagcttccaggcataatgacacatcactaaagctttgactgttaaagccctttgctcatgggtgaagaaaagagaatggcaagttaaaaataatgacttaatcctcatttacattgcaatgagttattctcatttgtggaagagggatgtcttcgatggggaggataatgaaggcgatgagaactatcagaccttttgtgcccgatcaataggtcccataaataaaatctcaaatcacacactacaaagtggaaatcatgtgtaatgggaagggagtgaaatcatcatcttagggatggcaagttcttactgagaaggatgacttcatgctggacctcttgtggtttccagagctgtagatgaataaattttcatcccttgattgataataaattttttgaggacaaaaatagttctagattgagaattcagtcattagactagactcaaggggacatactctagggacaactgtgggagaccatagactagacgatggctttcttacctgcaggaacaggaaaaaccatcttcaattttgtggtctgggagggactgtgcctaagcaatgagaataaaaatacaatctattctattgaaaaggtctttagagcatccttccagtaatctaaaagtgtgacaccccaaatacactagttctttcattattttcttcttccttctctttatcctgaagcccttaagtctactcaattatagaatttcttcataaatgacttatagggccatttttgctgggaatggaatgattttccatatcttctattccatcctacctaattttagtcaacctgaaaccactgctttttgtgaataacgaatgtccaacagaactcccaccaacctcacagtcccagacatctgcattactgtgggtagtcactcaaatgtagctagaggaggctttaccagaaaagctaattgccccaaactttcctcttggaattagagttgagtttttgttggtttgttttttaatgtgcccaattaatcttttattggtgtgggacaaatgttgagactaacaagaagattttggataagtggataacaatctcgcaccctacatccctccttcatgggggaatgtaagtgtggattgacccaaagcaggaactctaggggtgaagcaaggactcagctctgccttttcatcagctctgatcatccattagagatgtccaccctgggaaacatgggaaaattttcacaccacccaaagccctgcactgattccaccacaagctcccagtggggtctgggccttgtatgtcaacacagcaagatagctttgtatgaggacagtttccttcccaccagacgttagagtcatcctaggaacaactgtccaaccctgggcacgtgccacccagcagcacttctgaatatgccactgaggggagagatgaaataaacacctactcaaacccatacatctttcttaaattagccacaactaatttctttcatgctgatttttatttctaaagctgtgatttccaaagccataaactttgggtctgaatgaaattaagaagggttagagggctgggcacggtggcttatgcctgtaatcctatcactttgggaggccgaggtagtggattacctgaggtcaggagttcaaggccagcctgatcaacatggtgaaaccctgtctctactaaaattccaaaacaattaggcaggcatggtggtgggtacctgtaatcctagctgcttgggaggctgaggcaggaaaatcccttgaacccgggaggcagaggttgtggtgagccaagatagcaccactgcactccagtctggccaacagagcaagactccctctcaaaaagaaaaaaataaatgggttagaaatacagctagacgctaattcagaccctctccttctcatactttccatcaaacccatttttctttctcaggaattcttttttttcaattgctgttaaatatataatataaaatccaccattttaaccatgtaaaagtatatactttagtggtacattcacatcgctatgcacccatctcctccatccatctccagatccttcctactttccaaactgaaactctgtccctattaaaactaactccccattcccccagcccctgcacccaccattctacttcctgtctctgtgaatttgactaccctggggacctcatgtcagtggaatcacgcagtatttgtccttttgtgactggcttatttcacttatcataatgtcttacgggttcatccatgttgtagcctgtgacagaacttccttctcttttaaagctggatgatattccattatatagacagacaacattttgtttacccatttatctgtcaatagaatcttggatggcgcctactttttggccattgtaaatgatgctgctatgcacatgagtgtacaaatatctgttcgagtctctgttttcacttcttttaagtctatgcctagcagtggaattgctggatcaagtggtaattctatgtttaatcttgaggaactgtcataacatttataagaagctcttaatatttccagaaaccatcccaaatagtggatgagccaagaagacaaagtcatttcaatgccattttgacactcaagaaattaggccttaaaatgcttaatgtacaaaagaacaagcaatatacacttgtctctcttcaatggaaatagagttatttctgtgtgagagtctgttactacattctgtggaagtggctggagagtttacctggcttacaaagtctgttttgaatggcctgtcataaaatttgcatttggggactctggcgtggcacttcaaaaggtcagccaccattctctggaataccatgtgattggagaagcagattgtttccttcctcatggaataattgtcctgtcctccctggtgtgctttctacaacaatcagggtccaccgtgcatgagaggccagaggacctagttctgggccatggactagattcctgacattgggcatttactgtttctgagttccttcctaccttccttccttccttccttcctacttttttcccttccccttccttcctgtctcccaggctggagtgcagtggtgcgctctcggctcactgcaacctctgtctcctgggttcaagcacttctcctccctcagcctcctgagtagctgggactacaggcacgtgctaccatgcttggctaattttttgtgtttttggtaaagacagggtgtttcaccgtgttagccaggatggtctcgaaatcctgacctgatccgccctcgtcggcctcccaaagtgctgggattacagacgtgagctattgcgcctggcctgtttctttatgagtaaaatgaataagcttgcatgtgaagacaaccccaagtctcttccagctctaagttcccacagtgcacggaggcccagatgatcactgcaggaataggaaaaaccatcatcaattttgttgtgtgggagtgtctgtgcctaaacagtgagaacgaaaatacaatctattcattgaaaaggtcttcagagctcagtaaattttgccaaattcgatccatggtatacattacacctactaccttttctgatttcttttctctctttttcctacaaataatcactcttcctcaggtctggggatagtccagtgaacttgacagagtcttcaaggtctttcctggggccagactcttgcggcaccagctctgtttaatgtaacttcacaaaactgctccatagcctgacttcctggaagggtgttttcctgctttcccagatgaccagaaggacttcctcaatacctactccgaactctgctttttttttttttggtccagacagaaacataaaaagagaggtgcagcattccaagatgcagggagcgcaaaggactgggaatgtcaggagaccatgcttagccacgcaggaaggcgctgaggaaccgtgctactgaaaggagaatgagagctgagccccaggggaggcatctgcagtctcccaggagaaatttctcacatgcactgactcaagaaaatgtgacgtataatcatgaaagacatatattatacacaccatggctgattcctacgaaagaggaaaacaaccaggcaaatctatctgggaagcacaattataatatttattcacttgagtaggactctatcctctgatttaacacatggagtgaggacataagactcaggactgggatgagaaatgtaaggtgcatgaatttcaaaaataataaaatgaaaatatttatttgcttatggttcaattacgtggaatagaagcataagcagaaatcaaatggtcaaacttacaaaatctgctcttctttctgaacagtgatcaatggcctcactgaaaggactcagggcttggatgtctctgtggggtagtttattctagcacttgtgtgtgttttgccttggcaacacggaccaaggcaccagaatagcacacagcagctgaatgccatctcgaattttctgatttcactcccaggcttccagtcttttctgttatctttttttattttgaaatcctcattatgtgtttgctatatgaaagcacaccaaaatgtagcatgacacagtccctcccatgaaagcagaatgacacatggggaaggaaaaacatgatccaagggctgggagatggtgaagaaagtgctgagtgtggaccaaggtcatcacttgcctctgtagctcccctggcaggactggacatgtaggaggcacccccacagtcagtatttatttggtgttctaggttggaataatagtgtgattccattcaagggaaaggaacaaaatcagatcccagttgtaacactcattgcagcattttccttgagtctggggcaggtgtgtccagcgattctgcttggagaaggagaagatcctacagatgagcttctccacagggtgagagttgagcacccagcacggtgtctgcacagaggatgacaaaaatcttgaatgaatgaatggagttgaataagcaaacctaggacagggtgtggaaggtgaactcatggttcataaagtcagatactttggcattagtgaggtaggcctgtgtatgtgagtattcacacgcagttgtttctgtacttgtatgagagttactaatgttgatctagttgacattgtttagttcctagcataaataaagtatcatgacattgtttaagggaagaaaatttactttgtaattctgtggtgttgaaagtagggaaagaaatatgttgccttttaaatacacagcagcgctctcatggagatcacatggaaatgacagcggtgttgtgtccggaaagcaaaagcaaaacaaaaacgagaaaaaatgaaaccaacagaacttgggcacttaagaaatccatttcctaatggagtaaacagatatcgcactgcaagttacaattttcaacatcgtttaccctacacctccaccattcggagaggcagctctaataaatgagatgcagtgatgacctttaccggctccaccgatagctataaattgagctgaacattcccatcagctaacaggacagaactcattactgactgaagattgctacgatgcctttgactgagatgtgtaccattaaaatgaatgctccttcactcgtaaaaacaatgtcttgtaccgcagaagacctgatatgccattcattgatttttgtggatgactacaagaacaacccgtaaagattagctgagtcttactgtgtgttagttaaattatgattcagatcaatttgttcttttttgagagagttgattttttgtttcttaaattagaacctttgtcgatggcatgcatggaatataattgtcagatttacagtcctgatgattcaagcttagataaacacttgttccaaatacattaaagtaaaacttatatccattaaactaagtcaggattttgaatttttaaagctttgggtacatagaaaaaatttggttttgccgatttttttggcaaaatgactctgactttgagaacaaaccagtgtccatgcccaggtgacagcacttgccctgctgtgattattaaagcagccccttgcactgccaagtgtcctagtccagatgatgaattgcacagtcttattggaagtatgtgaaatgggaggactgtagccatacttgatctctaggatacacttttatcaggccctacaggtaaagtattcccataggccttgtggattttcacaggaaggcctaagttactcagatgtctgggagttgtccctggttggtttctgctaataacattagtagtcctgacgcttcatacttagcaggacctaataggtgaacccagatatggttctaatgtcatttaagttattaattgacattattaatatccccattttttttcagatgggagtatcaaggcacagaaaagccatataacctgtctgaggttccacagttaatagctagtaagcatgggaatttcctaggactccaggttagggaactacatcagacacgggttctcatttcaccaggaaacaaatgcgaggacattcttacttccacttactacaatatattaatgactagtgtgtgatgatacctccacccactcggagcttagagtgataacccggttatcctgcagctttcagatgatgggttctacctctctaattgactagactttctctaataatactggcaaagtctttatgggtcaaagtcagaagggaaagagtctctagtcagagccagagtcataagacacagtgaatgtatactaatgatgccacttggtaaacttccagcatgttatgctggaggaggctgggaggcagtctgtccctctgtccctctgtccttggtggcacagacagccccctggagccagccaaattcagactcacattctgcctaaggcagagggacacaggcagacacacgctaccaggagacgtctgcctttgacatcccacgtttgtgacacatgccagatcttctcagaaagaaacagtgcaccacagccactgtgccatcaggcactttgacactcacagacataaatgggcaagtcggaaggagtagatgattccctctaagaggacctgcctacttttcctgggagagtgaagaaacctctaatcattggtttctctgtttttccaacccaatgagtagacagaattgttccatgtaatgatttttcttctctctgtataagacactggccttcctgctgtttgcattttggattattttgtttgcttttaagtcagaaggacaagagttgtgtatagacaagctttatcatagattctacctaaaattcttctggaatatgattcagttttttcctttgtaaataaaatcataggtgaatgtgtggtcaaaaggtgtagttggttttcccctttcagagatctgagtgccgctgggggaggtggcatctcatatttataaaacatgttatttattttcttactttcaaaatgctaaacatagctgatctcaattaatcagcacagtaaccctttcagaaaaataaggtattctattactgaaaatgaaagactgcaaggtaaagtaactgctctcaaaaaacgctgcaatgggattagaaccaaattctcctgattccaaagccagaagttacagtcagagtatgattgtatttctttattaagattaaagtcagctctcagcagcagaaagattaaaataatactagtttaagaaagatggaaatttacttgtctctcaaatttatttattttccacatataagtccagaggtggaatctacactgtattttgcttttatcttccattttcatcttttgcttttatcttccaagatcacctaaaggaacaaaatggctgctctagctccagccatcataaaagccttcctgctagcagatatgaaagaggagaggggactatcatgctctatccctttcaggactctgctttagaggttgcactgcatacttctggcatagccagtctgtggcaaagcctaaaatagaggccaaatttccagatttttggaccaagctctttccaacaatctgtcccttacgcctggagctttttgtcaccgttgtgttgatgtaatctttggtcaagtttctgtctctcagcctatccattagtctttgctagtaggaggtgatttttctcagggatgcatagataaggtaaggtggaggcttggctccattggaaatgctgaaatgaatttactgcaaaactagtgttttctatgggagtgggatggggcaggaaaatctattgcatctccaccagccagaattcacttgcgtctagtaagacctcctcacatttccatcagtgtctacaacttacagagtcacaaaaagctcggagacaataggaacagacatcaaaattatcagtaacgcaaaatataagtgcccatataatgcctaatataagtagcatgtaccggacaatgcctcgtattctactgaagaaatagccagtgatcttctggcggcccatttcaaagtcttaaatttttttgacaccttcagtaatacttgttattgatttgctctaagtgaggttttttaaataatagaatcatcataatccctttagagatccttcaaaaaatcttagatttatataacagctaatcataagaatccttaacaatgtgtatatgcgaagtccttttgttcgttatcaggaaagggcttggctgataacacatttctgaggatattcattcctggataaatttttaaggatttttattctttgctgatctttatttcaccttcacccctctcaacatttgaaagcctacttaactctatattttcttttatgttaggttcaagtgaaaaaataatttgcaaaaacaaatcctaattctacaaataaattgtttttttttttttccttaaccatgtagcaggtggttgacaatattaaatacagaaagagggccttcgttgtttcagtggggtttcagtgtatcaagctgtttaaaagtctaaacaggactctgttaaggcacataaaaattgaatagaaaataatggaaatgtaaaagattttaaaagctatttgggcaatgcattaatcaaaggcaaattgggcagtctcagatcttatgattaaaaattaagtgaaattgaaagccactaaagtcatctttgaaatgtagctacttcccaaataatttccaagctgtgattatttttttgaaagtacgaaagtacttatcaatgtcattactgacgttgtaaaaatagatattgtggtatcattttaccgtagtttgaagtccacagaatgtaataaccctcctctcagtctatccacacacgcttacccatttcagccccagacaattctccacctttgtttccaaggtttagggtttctaaagcaaatgcctcctaataacctcagacttacaaaatacagtacctggttgcattcttgaaagggggaagaaaaatattacgtggtctttctaactcttttttttttctttgagacggagtcttgctctgtcccgcaggctggagtgcagtggcgcgatctcggctactgcaagctccacctcccgggttcacgccactctcctgtttcagcttcccgggtagctgggactacaggcacctgccaccacgcccggctaatttttgttgttgttgttgtatgtttagtagagacggggtttcaccgcgttagccaggatgatctcaatctcctgatctcatgatccgcccgcctgggcctcccaaaatgctaggattacaagcgtgagccaccacgcctggcctcattcttattctcaagatcctgcaggaaaatcaggtgtagtgaacctcccagtcaggttatcccgccacgtatgttaaagttgccagcgtaagttggaatcaagaggcctgcgtgaggcccttgagccagagggagctcattaaccagccagcaattctaatgttcacatctcacttagggtcttggagaagctgggaaatctccaggtctcgggagcacgtctcacaaatgtcaaggctgtaccaccttggttaagcgcttactggcagggccgctgaatgctgtttgtatttagaatggaaagaaatattactagaaaacttgctcttttgaaagaaacctttgtacctctttggagcccacattgccttcctctgacaatttttgtgaggtaaaccagaaagcagaaaacccagacacgagaaaaaaaaattggaactctgtctcctccctccaggcctaatcctacgtactaaactgcagccccgctgtagagcttcccagcgtctgctcaggagccccctgaactgtcttcacctgtacaattagtgggtgttatgggaacgtgcacctctggcttcccaccttcggtatctcccacttcctgtacttgttttacctaaacacgagaatagttgctcacagtttagtctttctcaattctaccctcacccaacgttcccccaaaacccacctctggggcggggatcgccttcctgatcatccagggagaagcatctaggctgttttgagtcactgctcctcactgaccgagtcattcccaagtggtgcctgcactgtggacaagagctccaaccctattgtacgtttctagaaatcagggattatgtggtcttattttctgctccattttttatgaaatattttaaatattttcttgaaagggggaaggaagacattactgtggtctttctaactcgttcttttcttttttttgagacggagtcttaccctatactgtactctacagaaaagtagaaaacatatttcagtgaacacctatattaccagtacaaatgccaattaatttcaatgccttggccatttttgtgtcctccatcagttctttttttgctgaaaatatgtaaacataaattatactctcattttctttcatccctgaatactaaaacatgcatctccaaagtgtatcttcccatacatccacaggaacatcattgtatctgacaaaaacgaccataatccccaaatatcattacattcccaggccatattcaaattcccttattcagtctcaaaatattttctgtagcttttgttttctttaagcctggatcaaattaaaaatcataattgtacttgattatgtcttttacatttctcttaatggtagaatggctcctcttttttctgtgatatatgctatttcacaatacacctggattaggccagttgtattgtaggccctcctgcattccgcacttgactgattgctttcttgtgaggtggtttcacaggtttatctataatgtctacttgtcccatgattggtgattcgaaggggagattaatgggcaaaagaggtgaccaccaaatttctctattataaacatgtttttcccattgagaatggcgtattttctgtgggataatatcccattaacttttctccaaatgaggttagcatccatcattgatccttacctgcaccaagttttacgacaggggctacaaagcggtgatgttctgaattaatcacctcttctacacttacgagttgacagtcttctgaaaggtggaactctccttcataaacaggctatttggtgtacctgaagtaccaacaaagcaggcagctgaatccttgtctgtttttaattattagttttcagattaagaagttgatatcatagttatgttcagctatggaaaataaatagttttgttttctttaatgttttgtgagtatcactattgacttgtgctttctaaaatgtattcactgtgtcttcatcaccgatagcattattcttttggtgtttggattgtcctaactttgaccatggagagcccctccagagggttattctgtccttgtgtcagttatctaatgccacagagtgctgtgtaataaacaactaacaaccttccagaacacatagaataagtcatttttcacaaacctggctgttggcaggtggtggttagggaactccacgtatctcatggctgatgtgctcacatggccagacacccagctggatgttggctgatctggagtggcctcttcttggatgactggagcaactcggtttgttcttcatgcctttgatccttctcctgggccaggacactagaccaggcatgtttgtctcatggcaatagcagaacccaagagaaagcaagtccactgtgtaagagctttttaagcaccagcccgcttctacttactgatattccattgcccaattctagtcctgtgtctgagcctagagtcatgagaaaaggcccggaaaaattagatggaaaagggtggggtgaagaattggagccatttacaatctaccatggtcttattgatgtgtccttatcagtcacttgtctcccccactggtctttgctttctggccagtaagatattttagatttataatatactttgtgtgcctcagacctggaaacatccattttttcaaggatccctggctcattttggggagaatggtactcagagacaaaaatctgggtgtctaggataatcatgcttctagcccgttttcatggacaaaactagcaagtgtgtagttttgaacaataaagaaacattggttcctattgatatttctgatgcaaattcaacatcacagagttttaaattttaactgaatttccttttgtttgttaaagacagggtctcactctgttacccaagctggagtgcggtggcacaatcatagctcattgcagcctcaaactcctgagctcaagaaatccttccacttcagcctcttgagtatctgggactacaggcaaataccaccatacccagctaacttttaaattattttttttgaagagacggagtctggctatgttgcccatctaatttttcaggctctcaaactcctgggctcaagctattctcctaccttggcctcccaaagtgctgggatgataggcatgaaccactgcacctggtctgaatgtccatgattaaaaatgtgggtctcttttctcttgtacagaaaatcttagctcctaataacattaacggaattgtttattttcttggaatgatgtctgagagcacaatgctgtgattaacacggaatgctaccacagctaatatgcagtaactgtcatatgattatcagtttcattaaagtcagagaacgtggctaacacatggtccataccaaatatctagcagagcatcccgtacattgtaaatattttttaatgcataaaatgtctattggttttgttgttttgttgtgtttttttttttgagttttgcttcttgtacctatcatttctctttttggaaacacctaccttttctaagcatattctcatgcaaatgagttactgatctactttaagcagaatgcacataatttcttttacatttcctcaccgtctctatgtgtagtatttccttgatatgctaaagggctgtgtgcagttctcataatcccaaagaaaaggatgtagttatcatgttgcgtactttttaaaaatatcatgagttttaacaaaacctaaaaaccagaagaggctttggcatttccatggcattcaaactcctactttttaatccattgattctgatgacgattactgaggctcctgctacaatataagcctgcattcttttttaaggtcttgtgacatttgggttatgctggaatttgtttttaactatttaaagatttcctattttgtcccacagtggttgtcttctttatctttaagataatatctttaacactgaagacattattggcaagaggaaggtctggaggtctgctcaccacctttggtgttctcttccatagccatggcctgagaagggtgatttttccaggtgaaagataggctgtggtgtaaactaagacattccaaatgaaacataatcacttaatataacctcgtagatagtgctgtccaaaagaactttctacagtattggaaatattctatacccacagcatccaacacagtacccaccagctatatgtggttactgagaacttgaaatgtgtctagtataaatgaggagctaaatttttaatgttatttaattttaattaattttaatattaatggaaacatgtggctagaggctacatattagcagtacagttctagattataaatatggtccaactaaaatatttgcatttgactcatgtttcctgaaagaaactggcagtaggaattaatgtcagctttctaatcatttttgattcttcttataacttgccatacacaccttattgcttaagagccaaaggaaaaatcactcttcatgagaggcagtgtatctacatctggactgaagaccttcatttggctgctgtgagttcataggctcccagctcctgactttgcagcgaaaaatttcagaattggagcttgtggcccagtgattattggagaaacatggtgaaaacacaatcactaatagcctgcaactgaaatatcagattaattctataaacacaaattactgcagaagcccaaaagggatgaaatgaaagacaggtgcaacagacctttatttacgttatagctgcatgatgtttttaaaacttcttgaactgtaaatgttaatagaaaatgttaaagtagaaagaatagtaaataaacctccaaatctgtttgttttttaagtatcattttaagttcaagaacttatgcatagtcgatgagcttcaatcttttgcagttattagttttatcaatgctccaattgttttattcttggccagtgggagcctctccaagatggcttctgagtcattttgacatggtcctaataaactttgacctttgggctcagatattgcctatcacagacatggaattagccatttacagagagaatctgggtttcatttagtgggaaatggtatttctagactgcagtgtggatactggagattacagattaatattttatgaccataatattgatgttgactgtcttaagatatgtgtatgttgtatgctatttgttatcagaacatacataaatacaagtaaattatagatagaaataaaataaataatagaacactgtttctattgctagttatttaaaactaaaagaagatgataggagaaaaattaaatttactacattcattgtgtatactctttgtttcagaaattaaaatctattactatgtagggattctttgtgatatttatacaatcagggattaatgtactcttcaaaaccaaacagcatatataaattacacttagtaatgagatttgttagctcaattgttaatgaatctacagtaccataagatgccataacattatttaaatttttaacatacgcatggtcttcaaaagcctttttaaaaatgcattattgtcaagcaaaagtaaacaacatataaaatcagctgatctatgatactatgagtaaataactggcattttatctaattgttgagagagttagaaaaaataatttgttattgttatatcagtttgaaaaaaaaaacaaaaaaggaatcatcttcctagtcctagctaccaatgcaatttttttccatttctgtaatattttcagcttgaagaatcgcataggtacacaggaaaatgagatgagtggcatattttaaatgcaaagcactagatatattgcacatgaaaagtaactagcaattggtggtgctgtaagctttccttttggaaattttctcctaggaatctgacattgtatgtttcttagaactcccattgagcatggcttttcaactttatctccctatccatatagcgttaaaatgcactctacactcccctatgtaacatcttattgctttgcaattataaggataaaataacgataattgaatctcataaagaggcacaaaaggtataatttgacaaaaaagaaacaccatgcctacgcctccgtccttactccacctctgtcatggcctcctcattctagagcagttactcttacactagtggttctcgtcattgttttgtatgtaaggtggatatttggtgacttagacttatgatagtattaattggctcaattcctcatacatatatttttcatctaactttgtaccagtcattatgctaggtattagagatagaaaatcaggaagctgtggcctcttctctggcgaatcatgtactctagtgcagaagacagagagttattacaaacaaataactctatcatgctgtgatgaatataaaataggatgaatgaagtatggactgaaagcagagagagattaattctgcctggaaaaggcatgaaaactgtacaagggagttggcctttatgcagatcccaggaagatcttacccggccatagtgggagaaggacattacaggtgcagggagcagtgtgagggagtgcagaggattgggagacatggtggtgctccagatgctttgttggggtgataggcattcaaatgggaagaggggccaaggccagaatcggaaggaccttaaatgtcaggctaagaaacttgactaaaatagtttctgccaaagggataaaaaggagttttaaaagagagatatggctttgtctgcatagagaatggaaataaggagagcgacccattaggaggctgctggagtagtctatggtgaaggtgatgacaatcagaaccaaggcagaaacattggaaatgaagaagacaggtgatttgagaaggcttcaagaggaagaatgggcaagtcaggaaataatccagagaggggatccccagtcactgccttcccacattgctgaatgacctgtgaatcatatctgtggcagggaatcaaggcaggtcagctaaagagcttaaacatcttcactaacaacactaacaacaaagctgctacccaagaaacaaacttggctgtgtaagcctagcaaagaaaattgcctgctagaacaaaggaaatcacatttatcgggagataatatcaaaacccagaatgtccagaaattaatatccataatgtctaggatataatccaaaattacttaagatacaaataaccaggaaagtggaacacatgctcaaaataaaagaaagctaatcatttgacctggaaatggaacagatttctggaactgacaaagattttttgaaagctattataactatcctcaacgaattaacataagcctgttttgcaatgaatgaaaatctcagcagagaaatagaaaatctcagcagaaaacataaaggaaccaaatggggacttataaatagaacaataaaaattctgaaattaaaaaattcactggatagacttgataatttaattaccatgacttaggaaagattaaatgatagatcaatatccaaggtgaggctgggagtggtggttcatgcctataatcccagcactttgggaggccaaggcaggtggatcacttgagatcaggagtttgagaccagcctggccaacatagtgaaaccctgtctctactacaaatatgaaaattagctgggcgtggtggcacatatctgtggtcccagctacatgggaggctaaggcaggagaatcgcttggacctgggaggcagaggctgcagtgagcagaaatcacaccactgcactcagccagggtgtcagagtgagactctgtctcaaaagaaaaaaaaaaagaaaaagaaaaaaaagaaggaaattattcaaaatgaacagggagaaaatttgtttttagtgcgtcagaggcctgtgaagagatatccatctgcccaatttatgtgtaattaaaattctaggagagaaaatggataaagaagtagaaaaacaatttgtcaaattaacagctaaaaatgtgatgaaagacataccttggcaaatacaagatgctcagtgaacatcaaacaaaataaacacaaaacagctcaatctaaagcacatcacatcattagaggaatgcaaatcaaaaccataatgagacaccatctcatgccagttatcccagaacttgaaaaaaaaagtcaagaaacaacagatgttggcaaggttgcagagaaaatgtagcacttttacaccttggtgggaatgtaaattagttcaaccattatggaagacagtgtggcgattcctcaagatctagaagcagaaataccatttaaccttgcagtccaattactgggtatacacatgaaggaatataaatatttctagtataaagatatgtacacatgtatgttcactgcagcactgttcgcaatagcaaagacatggaatcaaccctaatgtccatcaatgatagactggatcaagaaaatatggtacatatacactatggaatactatactatgcagccacaaaaaggaacaagatcatgttttcttcagggacatggatggagctgaaagccattatcctcagcaaactaacacaggaacagaaaaccaaacaccgcatgttctcacttataagtgggaagtgaacagtgagaacatatggacacattgcagggaacaacacacactggggcctattgaggggaggcgttgggggagggagaacatcaggaagaatagctaatggatgctgggctttatacctagatgatgggtcgatctctgcagcaaaccacctttatacctaggtgataggttgatctgtgcagcaaaccagatttacctatgtaacaaacctgcacatcctgcacatgtaccccagaatttaaaataaaagttgaaggaaaaaagagaccaaaagaataaaagcacataacagtcagcttcaaaagccaaaggcagcacgtaaatcttaaaggcaccaaaagaaaaataatacgctctgggaaataattcaattaatggttgacttctcattaaaaaccatggtgaccagaagagagtggaacagagtttcaaaatgctgaaaggcaaaaaacaaaacaaaaaaccctataaactggaaatctatattcacagaaaatattcttcaagaataaaggttaaatgacattttcagataaaacaaatataaaataatgtgttttgccagcagacccatacaaaaagaaatcctaagggaatttcatcacggaagaaaatgatatacaatggaaactcaaatcttgataaagaataaaacacatcagaaatggccaattgtggataaatgcaaaagacatttttttctttttgactttttaattttaatttctttataaaccatgttgtgtcataaactaaaactataacattgtcttctgtaatacgtaaattatgttgatgtaatacacataacaagtataattgcgtggaagtggacacggacctgaaagcttaacaggtttctatagttaataagaagtggtacattattaactgcttctggactttgaaaatttaatggtatatattataacttctaagacaaccacaaaaaaagctaatgcaaagaaatgcaactaaaataggaaaattaaaattctaaagatatttaaacaataaaatgaaagccaaataatgagagagaaacaagacagaggagacacttagaaaacaaacaaacaaatgataaacccaaacccagccatataaatggttttcttatatgtgcatatggtatatttaaaggttagactatattattatccataaaaatgacgtttcaaaagactgaaatatatacagagtattctttgatccagtggatttaaattttaaaaatctataacaataagatggtcagataaactttaaatatttggaaattaacagatttcaaaatacctactgggcatatgagacatttgagggaaaattggaaataatttgaactgaataataatgtaattgagcatatcaaaatttgtgagacgtcactaatgctatacacacaggaaaaattttagctttaatagtttaactagaaaggaaaaaaaatatcaaaccaaagacctaggctttcatcttaacaagctagaagaaaagaagtaaattaaaagtgaagcaaaaagaaggaaggaataacaaagaaaagaaaataactttctgaagtagaatacagaaataatacacatgataatgccaagagcttgttctttgaaaggtcaataaaattggtaaatatccagtttggtcaagaaaaaaagaagacacaaatgaccaattcaggaaataaagtagggagataaatgcagatgccacgatcctactaaagcataacctgttatcttactaaaaagataatatgttattaattaatagaaaatgcatgcatattttttaaattaatatttttaaataaataatttatttttaaaataaaacaaaatttatactgatggggttcaggatatactaccaaaaaatatggcaccttggcagtggaggaaatagcagaaacaaaggtctctctgcccttcctccacacttctcccctaaagcaggtcatgcaagaatcctctgactttcttctgaagaaggttacaagactttcattctagaagtgtcattcttgtactcagaagaaaggaatttccttatttcacaagacacagggacacaaagaagaatgtcaaccaacaggccttgctaagttccccatttattaccattagatcacatcacctttcttcaattatacttctccataaatgtccaccattcatcaaaccaaagcataaaaatacacaggtttccctgtttctttggatgttcctgtctgaagtttcccatatcacataaaacttatgttacataaatgtgtatgtttttctcgtgttgatgtgtcttttgttgtaggtgcctcagccatgagaccctgatggtgaatgagaaaagatcttttctctcctacaataccaatacattttacaagctagatgacatggacaaatcatcaaatgactcctattttcaacaccgacctaagaagaaataggaaactgaagcagctctatttcggttaaagaacttgcatctgtaatttaaagccttctcacaaagaaaacttcatgcccagttggcttcattaattaattctatcaaatatttaaggcaaaaataataaaaacccaacataaattttttcagaaaatagaatagaatggaacacttcccaacttattttatgaagcagaaatactctcactctaaaaccagataaagaaatcacaagaaaaaaaagaattaagaccaatatccttcatgatcatgaggcaaaaatgcctggcaaaatattaacacataaaaatcaacaataggcctggcatggtgcctcacacctctaattccagcactttgagaggctgaggcagaagaattgcttgagctcagaggtctgaaaccagcctgaataacaaactgagacttaatctctacagaaatttaaaaaattagccaggcatggtggcatgtgcctgtggtcccagctacttgggaggctgagttgggaggatttcttgggtccaggagttcatggatgcagtaagccatgatcatgctactgcacttcagcctaggtaacagagcaagaccctgtctcaaaaaaaaaaaatcaatactatataaaacatgataatatatcatgaccaatgggtttatcttaggaatgcaaagttggtttaacatctgaaaatcaatgaacatagctcactgtattaatgacaataaaagagaaacctcataagataattgcaatagctgcacaaaaggcattttataataatcagcgttttatgataaaatctttcaacatcctaagaatagaagggaacttcctcacttattaaggtcatttatgaaaaaaaaattacacctaagttatattcaatgatgaaaagttcaatgctttctgcctaacattgggaacaatgaaaagatgtgttctaatgctgattttatttagcattgtaataaaggtcctggttagtgcagtaaagccaaaaaataaataaaaggtacacagatttgaaaggaaggagtagacctgtccttatttgcataacatgattgtgtatgttaaaaccctaagaagtatattttttaagtgaactagaacaaaaaagtgcattgagtaaagttgcaggacacaaaatcaatagacaaaattaactttataattacaaactaacaaataatgaaattaaacagtaataccatttacaatgaaaaaatattgggaaattttgggattaaattattaaaaagaaattcaacatctgtacatgaaaactactaaaattccaaaatgaagctaagaacgatctaaacaattagagatatgtactatgttcatggattggaataagcaatattttttaaatggctgttctccttagattgaattatagattcaatgtaataccaatcctagtcccaaatacttgtttgatgaaatcaacaagataattaaaaaatttatattgaaatacaaaggacctaaactatccaacacaattttgaaaaagtaaaacaaagtttgaggtcttatactacttgatttcaagacttactctaaagttacagtaatcaacacagtgtggcattggcataagaatagacacagatcaatggaatgggatagaaagtccagaaaaagaaatctacacatacattttcaattcatttttgacaaaaaaaaatgctgaagtaattcagtgggaaaaagacaatcttttcaacaacgtactggaataacaaacgagttatgtatctgaaaagaaaggaacgttgctgcttgttacatatactgtctaaaagataactaaaatttgatcgtagaccctaaatgaaagagctaaaattattagaattctaaaagaaaacatgagataaaatctttgtgacattgaggtaggcaaaaatttctcaggacactaaaaatatgaatcataaaagaaaaatacaaaaaatagatttcattcactttagattttttttttttattattatactttaagttctggggtacatgtgcagaatgtgcagttttgttacataggtatacacatgccatggtggtttgctgcacccatcaacccatcacctacattaggtatttttcctaatgctatccctcccctagtcccccatcccctgacaggccccagtgtttaaaaaattaattgggaaaagaataaggaaagccacaccctggtaaagaattttaaaaaatacatctcagacaaagactcatatccagaatgcttaaaggactcagtaataaattgtaaaaaaaaaaaaattaaaagtggacaaaatttttcaagatagtttgcaaaaaacctgcaaatcacccataatcacatgagaagatgttcattattactatgtatcatcaaaatgcaaattaaaacctcagtgagataccactacacacctgctagagtggctaatgtttaatagactgattttgccaactgatagtgaagaaatgatgtgcatgtgactcttatacaattgatggtggaaatgcaaaatggtatagctactttggaaaatagtttggcagtttcccataaagttaagtgcaaacataccatatgacccaacaatataatagctacaacctggcagcaatctaaattgtcactaatgcatgaatttgaatgcataaaaattgaggtctgtcagtcctatagattactcctttgtagtataagggaatgaaacattaatacatggaataacatggataaatctcaagatcattatggtaagtgaaaggagagaaacacaaaagactatgtaatgtgtgattctatttgtaagaaattctaggagaggcaaaactacataatgacaaaacagagcacttgttacctgggtctattgatggaatagatgatccacagtaaaggggcatagaggtctttcacatcccttgttagattcatttctagataggttatgttttgtgttatttttgtcaatggaaaaatataaaaactcatggaaagatgctaagaaaaatacctaaataaatggaaaggcagaccaagtacgcagaaggaagactcagggttgtaaaggtgtccagtttcctccaaatggaactttcaattgaatgaaatctcaatcagtttcccaggagaattctttactaatttaacaggctgaatgtaatgcatataaggctgaatctgacacatataataaacagcaaaatcctaaggaacaccaaacccttcgtgaaggaaactcataagggaaaatttccagatagcaagatgtactacaaaggtacataatttcacagtgtagtatcaatgcaggaatgagtcaactcatcaggggacacataaaaaaagtcccatgtgacccaatgactgcagatattcttgctgaaatattattgatcacatcacatcttatagagcgaataatgaccttctcaaattgtactgcaacaaatagttgcagatataaacatacaaaattagattcctacctcacaccatacattcatgtcatttcccagtgaattaaggctttattttttaaaggaaaattcaaaagtgtttcagaaaatatataggagaacattactatgaccatgtaatgggaaaatatttattatatatgtcatatcaaacacaaagggtaaacatttttactatattaataatttctgcttatcaaaatattttatatataaaacgaaaaccacaactaagaaaatgcactttcaacacataaaactaatgaatatttcatatgggatgtacaaaaaatctcttacaaatcaattagataaaaacattccaacagaaaaaagtgggcaaaataaataaaccaatgaattttataaaataagacaagaatagtaaataagcacatgaagagacttttaaactgattaacactctgatgatgcaaaataaaatcagagataccatttttacacccactgtattggaagatagtaagaagtttgaaaatagcaagttttagagaggatgtgagttatgagatctcattcactattggtgcctgttaaagtgtcataaccacttttgaaaataacttgtaaggttaagattcccataacccaggcaaaaccccgtctctactaaaaatacaaaaattagatcagcgtggtggtgcaagcttgtaatcccagctactgggaaggctgaggcaagagaatcacttgaacccagcaggcagaggttgcagtgagccgagatcatgccattacactccagcctgggcaacaagagtgaaactccgtcaaaaaaataaaaaaagaaaggaaggaaagaaggaaggaagaaagaaagaaaaagaaaaggaaaggagagaggaggggaggggagaggagaggagaggagagggaagaggagaggaagcaaaagtcttgtacatttttaccaaaagatgtaaagaagaatattcatggtagaatggtttgtaataacaataaaactaggaatgactggtatccattgtaatatacactagaatcgtgtacatcagtgagaactaagagccaagacagcatggactattatattcacctcagaaatatgatataatataaattactgaggaacacagtaaatatcaccttattaaggtcaaatgcaaaaaaaaactaaacaacatagtatttaaagatacataaatatgtgataaaactgttaaaagtaccggaatgataaaattcaggaggaaaaaaaagtaatcatacgttctaattctgaaatggtctcattggtttccgtagaaacaagcaggttttatgtacctcaaatgtagtacggcataatcttttttatgtatttatttattttattaagttccgggatacatgtgcaggatgtgcaggtttgtagcataggtaaatgtgtaccatggtggtttgctgcacctatcaacccatcacctaggtattaagccctgcatgcattagctatttatcctgatgctctccctcctcctgacccctgcaacaggccccagtgtatgtcgttcccctctctgtgttttcattgttcagctccccactgcatactcttaaacaatcattatgtttcatggtgatcagtaatgtgggggcggggtagaagcagagaacttggaactcgtgagggggtgtcaaaggtagtaaatcttcatccattgaaggcaaacttgatatttagaaattcattcagagtaaaagctaatggacgaagggagataaggtgacaatcaaattaagtagtaaccttttttgcaacttatataactaacaaacttaagtgctttctaaaaaaaaattctaaaatttgctatataagggcaacttcactgaaatgattgcagagtcttccatgtgagttcttttaatgtgagatagctcattcaatagatgcaccttggtgtgtttgcttaagaaacagaaaaatatgactcatttgatttgttcatgaaagtattaccaggaaaataaatgaaaacaatttcacctaaacatctgttaactttagcactgaagctttggatgtaatttacataatgcataaagtagattgatctaggaccatgtcgatgatgaaattttcattatattgatagactttcattttcctcataaaatctacacatacttaaattataacaactctgcttttgaattaatccagtctgcataatgtttttcagtcatcaactattatagtgtgaaatgcctttaccatcaaactggctcaaggttactgccttcactcagaaagatagtgttttccttctccccactgtgggccctgcctctcaacctgcaaccctacatttcagaaagtagtttgcctgtatgaaattttcttactctcttctaaggtagtggctgcaaaatggtacctatctctgattttaatttgcatcatcagagtgttaatgactttaagagtctactcatgtgcttacttactatttttgttttataaaatttcttggtgtacgcatgttctcactcataggtgggaattgaacaatgagaacacttggacacaggaaggggaacatcacacaccagggcctgttgtacggtggggggcagggggagggatagcattaggagaaatacctaatgtaaatgatgagttaatgggtgcagcacaccaacatggcacatgtatacatatgtaacaaacctgcatgttgtgcacatgtaccctagaacttaaagtataatacaaaaaagaaaaaaaaaaggcataaaaattctagaagaaaacattggaaagtgtctttatcatcttggagggtcaaagatctttctaattatggttcaaaactaagatgtcgttaaagatggatacatttgatgaaataaacatttttttaaattaaaaaaaattattggtgtatttattttgcctatttttttctgttggagtgtttttatctcattgattttggggagttgttttttatacaaccctacctttcagaaatacaccctttcattcataggagatatatatgtacatgtccatatgcataccattttgagtaagcgtttttactaattttctaaggggatgcttgaaatcttggttgttcatctacaagaggccagactcagcatctatgagatgtatagattcaaaggtattcatggcagcgaagagctaattcctccaagcaagagcacctaggggagctcgtggagcagatgaaagcatgttttgcaggatgtggctatgggccacaagcattctgcatacagatttactccaaagttggatataggaaattagtccctttactaacagttgtctttggctccttggagtatctgctttcttaatctgctctttgtgtcctgcccaagaacattctagctgttccaaaggttttcggtgtgtgcgcctgtgctttctatgtcaatgtgtaaagtaggagagaagcatcatgtgaggctggattaagaagagctgggcatattgcaccatattgaaagggccgtttgatgagtgggagcctatctttttttcagaactagtgattttactttacataagcattcgtcaaaagttgaggagagttccttgatgtttcatgtggtttttttctacttcctctcttacagatacagaattcatctacagagaacagaaaggaacagtgagactgtggaatgttgaaacaaatacttctactgtcttaatagaaggcaaaaaaattgtaagtactctctttaatgaccgggataatttcagtttttcttcctgcaagtcaataaaacagaaaatgacttttggtttcaacttttagcatagccaaggagaagcaataaacttgtaatactacaggctgagcaaccaaagataatgtgaaattgaaaccacgctaattcaataagatgaaagcactgtttctttcattgtctgggaaatttctctgcaggtgttgggaacaagtgttgcatatcatatataattaaaagataaagtcctaaggcttttacacatttacagaacaattgcaataatgcatgtagaatacttcaggagaatttgctcaatcctgtttaaaaaaagctcgtctccgcatgcataggaagtattaacttaggcactgtgactgtacttaccctaattatattaagtggatgcttatgcctcaaagtaaatactgagtcaatatgaatgccactgctttatgatttgggaaaacttgttttcccaaatatatgtatattttttgagacaggatctcactctgttgcccaggctggagcgaagtggtgcaatcatggctcatttgcagccttgacctcccaagctcaggcaatcctcccacctcagcctcctgagtagctgggactacaggcgtgtgccgccgtgcccagctaattgtttttgtttttgtttgtagagatagggtctcactatgttgcccaggctggtcttgaactcctgtactcaagcaatcctcctgctttggcctcccaaagtgccgggattacaggcctgagccactgtactcgaccccaaagatttaaatggcattaagatttgatgttcatgtacggttaaagatatgtattagaaatattgactggagttatacaccaaaatcaatttaaagagaattaacattttgtttgtttacaaaatgttcagactcttattagaataaataaatctccaactcaaagcagttgattcttttcttgtttgagacactggggaaatcaaaggacagaactaaggttaaagctatgttaaaaagcaagaattgaaacaggctgtgaatcccgttaaagcgatcataacagggctctggtatgaatcagaaacacagaaatcctagaatcctataatccgggattagaggaggttgtaaaaaaaattaaccggttccctggttttacagataaggatcctgagcgagacttagagcatgagcttttgagtctcacagctcagtgatggctgagggagcattcaggtggtgtcccagaagcctgtgtcccagggagaaggaaggatggcttcatctttaccctaccccatccccagatccacagaaatgctgtgctgccttcttttccctcctaaagaacatgtaacttgctatttaaatactttcatttcttttcttttgcataaagatacctttttattaaaaggtttgctgagatttagtattaaatgcatgctgcccctaacatagactgcaggcgtaagggaggcctcacgctgttggatgatggcatagttccaaaaatgatcactttattgaattaaatagtattctgcaaagtaggacctaggacaaatgaatgtgcctgcatttttgcattaaaaaaatcatctttggtagaattactcccctaagagaatctgattcaactcacttagaaatactaacgttgtagaaatggttttctaatattaatagagaggataaaatgatcagactgttgctgagcgtcagtgcattttaatgtcggaatgttatcattatttcctgtgaggatgtcagtttagtaaaggctgggtgttgtacataacagcagcacttagcaatgaaatacatgaatgtgaaccgccttctctttctaaaatcaatagcttgtgacagatcatatattttaactgaagttattttagccaagtcgcctttaataaggtgacttcagaaaccaccatgggtaaagaaaagttctcatctcagaaattcgctggcttattctatataatgcaatcttttttccttaaaatgtcacttttccatccattttataaacatttattaagcaccaaatatgtacagcctaatggattcattattcctttctcaaagctacatttaaatgctcctgtcaacagactcaaaataaagaagacaaaaaatgtcatttagaggtctgcatcctaatttaatttaatctggatttaatttccgcagagccacttagtcatttaaaattatcatgcctcaattgctctatctccaaattaaagctgatttcttctgccagcccagaacctgggtactctgtgagatccagcaatggaatatgtgtatgctctgtgtgttttcatgagcaagtatggagaaggtgaagcctggtgttccacaggggctggaggttggaggatcacccacagcctggaggaattgggaatggggagcagtagctcttccatattctgttctcttgccttcctggtgactgatcaggtgttctcttctcatttgaattccagaagctgtgagcttgtataaatgataaaaagcaatctgaggccaactgtaatttttaagttgggctataaaacagccttaaacaagttgagaaatggaaaggaattggtaaattctgtggtcagcagaattttaaaatattccctacaaccttgacctctaataacctcattctctttcccgagccaataaaaacagaccctcctcatagctggtcactgcaaggtaccaaagcctgtttgcctccagcttcttctttgctcctgcgcttactgtgattggctcttacatgggacaggtggatggaagggcctgcaaatcactgcaaacattttgtcaatccagcaggaaagcttttaagatagctggtgattaagcaaattcagagcttgtgctaagttctgtatttacatggatgtatttcacctttccttcccccaaacaatttcttttgactaaatttactaattcagtcatcctttattgtgcttttaaatggtagaaatcatgaaatatttcacaataccacaaacactttagattgttgagttcagaccaggtgcggtggttcatgcctgtaattccagcactttgagaggccaaggcgggtggatcacttgaagtcaggagttcgagaccagcatggccaatgtggtgaaaccccatctctactaaaaattaaaaagttagccgagcatggtggagcatgcctgtaatcccacctacttgggaagccgaggcaagagaaacgcttgaacctgagagttggaggttgcagtgagtcgacatcgttccactacacgccagcctgggcaacagagtgagactccatctcaaaaaaaaaaaaaaaaaaaagagtttctgtatgtgtaaacatttaaaattctatgatgattatattatggttcacaatttggggggcattcttttgttttatatatatatataaaacaaatatatatacacacaaatatatgtattttatatatatattttatatatatatatatagtgggctatttcctgatccttattatttgatagcatatcatatttgatggtagctaagaactgctttttagaaaacatttatcaaaatgtcttgatccatttcctcttttgagaatttttgaagtgcttgtctacatttctacagaaaatgaatcaaataaaagcacagttgtccccaaagcacaagtgcatcatctctgaagtagctctcctcagctgtaaaggctgctgcccagttctaagctcactggagcaggttctgtttgggatttaattttgtctcccacatagtgctcagcaccatgacctgcacatagtagatgctccactgctatgtgttttatgaatgaccgctctagaataacaaaacaatagagttgagcagttttccagaaacatccatgtgagtgacaggtgtggaggggcattcagcactggggtcatgactttgagcttcaggtctaccttccagccttggcattgtgctctgctcaggaacaacaggaccccagccggttgtgcaagttctgaatgtccagtcttatccctcaggagtgtcgtaggactgaattacagttgtaacagctggaatgtgggtatatgccacatgtggattccagagcgttaggctagaccaaagagcctgggccaggctcagggctcaggcaggaggagtgggttggttctatgaaggaagagacagaggatgatgatgtccaaaggagcatgacaaggatgctgccgcatgtgggcggctgcgtgggtccaggcagcagtagcagacagtggaatccacgccactttagttttgaggtccatccctcatgaagctggatgtagcctgcatcccagagtgaggcagaggcatccagagctggtaattacagcaagaggcactcgcagaactctaaacatcaataaaaaatcaaacctaagctcacttttatttgaattacatgtttgatgtcacagaaattccgggaccttacactttactcttttaaacacaattttaaatgtcaatgttattttacgtttcatgctccttataagactcttgtcaacaagatagcacatcttatcaaatggcctttgttctattatgtatcttgtttttttttcctaaaaaatgaaccaccacaaatatatctcatggtccaaaattggatctttggacatttggccaatggttgcctggttcctaaagtcctcatgaatttttatcttctgagtagaacactcctttttcctttccctccctccctccttttcttcatccttcactcctccctccctccctcccttccttccttccttccttccttccatccttccttccttccttccttccttccttgtagaaatacacttaaaatagccttaatacattttgctgaactaaatagatttcttggggacttaattcttacaaaaatttaacaccatctctccaattcttttaaaacataatagagcaaaaattatcagaagggtgaagtgtttcaccagtgcttaatatttagatatttaaagctgaaatagtctttagagactgtgtctttcaaactcttcttttatgaggtgaggaaactaagaatttctaagaacagttctctggcttaacctccactgatagtgctatggatgtaacgcaccagttcagaatgagtcactgtattgacctgtgtcactcatactgtataggccctttttattgacaatgctatcagtgacaagaagcattaagatttatatagtcattcattgtatcacttaaattctgccaggtgtttggaaagcaacttagtgatacgtttcaggagcagtaacaatattgatgcatttttatttgctctggggaatgcttctgtacaaagttgcagcattatttgttaatacaatagtgaaaatacttgaaactaggaaaatgagataactttttaaaaaaagataaaatatgatgtattcattaaaataatagctatgaagggtatgtagcgatacaaaaaatatttatgatatattttaaaaagatacaatatactaggctaacaactatatatattgaaaggctagaaagtgaacactgaactatgaaaatacttaatcttgttgggtggtgagattttgtgtattattttctagtgtggtgatttccataactgccatttcaatgccatttattcaataattttaatcgggatttaaaaattttggtttcatctttcaaaaaacagcagactgccttctcacaatgagtatgtaagagctgtagacagttcccggaaattcttgaaggagaaaataagtcgattatttaaaaaaaaaaaaaaaagtattctattgttatgcttatgtcaggctttctccatttttatgtcttgttttaattactaatttctttgttttaattgcttattttaatgactaaattaacatctaaatgaaatgtattttctctaagctgtatccttcttggttttatataatcatagatgtagaatttgaatttttatctctgtctctaaaaattaattaattctgactcctcacagaaagagacataaataggcaagtattattagacccattccaaaataagaagaacaaataataggcctgtttgtactaccagaggaactccagaatgtggctgagattagaactcgagactactttctttttacttcttcaaataaactccactggatacttgacccctgcatcagtaattctcactttattctatgtcatttaatttctgttaagtgctttatgcgctagtcctctcagccctgaaacagggtaaatttggaaggaaacagaagcccactttcttacctctttctcttttctgttctgcacagagcccagtgcactgttgaatgggaagcacaggatgttctgacaggtgtcatctcagccaggaacaggctggcccccgggaagtgggctcagcctcggtttcagctcctgttgtcctgagttcactgaccactgataaccaggacggtggctgcaacttcagtgggccagcaatggcccatgagccatctctaatctgaggctggatttcacttagcatgtcagtgaaaaccatgaggggaaacagccgtgtttttgtgtacggttgagagggcataaactggcagctcgtgatgcccactgaaatgttttgtttggcccacagagtggtttttacaaactaacccagatttctggcgtctcttgaaaaatacaaagatctggcagcagcaagatcctcatttgctcacagagagcaaaatttggctggagctaagaggcagctggcccctcagacaggacatgggccgaccagccctgcagtgacccacatttgctgacttctaaccagactggtctctgagtttgaaaccccttttagttcaggaacaaaagggtggcataagaactcaatgtcttctgcaagaacgttgcacattgtgagaaatcgtagcacaaactgtcttggtattatctgtattcatttctgtctgtaaaattccctggatcctctttgtccccctatgtcattatttcatttttctcctgtgtctcagagggtctctctctctctttttttttcttttgtctttcttgtcctacttttctctctcctgccttttctgtttctacttctcttactacaagatagaacagaaaacaagtatattttacttacttttattctaacttttaccacatagaccatgattttactttttaaagtggatgaggctgagcacagtggctcacgcgtgtaatcccagcactttgggaggccgaggcgggcagatcacttgaggtcaggagttcaagaccagcctggccaacatggtgaaaccccatctctactaaaaataaaaaaattagtgtggcgtggtggcaggcgcctgtaatcccagctactcaggaggctgaggcaggagaattgcgtgaaccggggaggtggaggctgcagtgagcagagaacacgccactgtactccagcctgggcaacagagagaaactccatctcaaagtaaaataaaaataataaataagtacagtagatgagtatttatacttatgtctttaaaatatctgaaaagaggccgggcgcagtggctcacgcctgtaatcccagcactttgggaggctgaggtgggcggatcacaaggtttaggagcttgaaaccagcctggccaatatggtgacaccccatctctatgcctgtagtcccagctactcgggaggctgaggcagacgaatcgcttgaacccaggaggcagagggtacagtgagccgagatggtgccattgcactccagcctgggtgacagcgagactccatctcaaaaaaaaaaaaaaaaaaattctgaaaagcagtacagtagtggtttaatctttctggccccagagctactgttccctgcaggctaagggctgtgtaccatcactcctccatcacacgtatactcttcaagtgacagtcagggaaggccttctctgtgcaaggccctgactagacatggtggtgggtggatacagtgattaataaaaacagatttctactcttatgtagctttcagcctgcatataaaagaagtagttgttttaacataatatattttgcaacggaggtattaatccaatgtgcaatgagaacaaggtgagaaagaaagaggattgctgggaactctagatagaggcttgcagaaggaacatttcagcagtccttgaacatgggagaaaagtcggaaatggcataataggcaaaatgaaaagggtggataattccacatttcaggggtagacagtgcggttagtaggttgttttgggaggggcttgaaaagttgtggctggaaggtctggggaaaaggtggagagaggtcttcaggaagcttccattgtgtgtagtctttagtctgtagcacatggaaaggtgtcaaccaaaattaaagctactgaagcagaaatgatgtaataaaggtttattggaagccacaggtgagaatcgatctgggaaaacacaccaacaaagttggacatgttccagaatctgttacaagccagaaggctttcataagaaagtttaggagaagtgaaggggactcctcatatcagagttgtcctttatcattaagaggtacaataaaaaggttccaatcactgacaacagattgcaacacacaggctaaaatgcctacgtgcaagacaatcagtaaaacttcatgattcagaggcaaatcagcatccttttcaatgtcagtagatcacacagtaatcagtacgtcaacaatttgaagagctcacagtaagattgtttacttagcgacaagatgacacacaagacttcttccccaggtgacttaatttggaagtttgccaaatgtgacctgtagggtattatttccctcttttgattaaaaaaacaacaacaactaaccatggaagcattgatgatcagtctctgcttacgttagaagggtagacatccttctttccttccttggctctgcgaaggctcattcccaagaagtcatgtccctgagtggggagaacaaaccttatcatcgcatgtgggccaggttgctagcaacatggggtagatcatgacacgaggttacatgccaatctcctgaataatgaatcaacctccagtctctggacgatcattattttggccttaactgtggaggcatagtttacaaattctggagaattcaggtacagagaaaggtaaatgttttaattttattcacaaaagtatactttacctgattgttttaaaatacaaatagctcctttatttataatttttagaaatatgttttgctatagtattgttattttatttggaaataaagaatgagtattatttaaattgaacataactttaagattgaaaattatgtaacaattatttataaaagtttatcccatttatatttacctaatttatttatttttaacagtttacctggattgctcatgaaaactgagatattggacaaagttagtcattatttcaagttacttccttgttaaccatttttatggcctgtgaatatcagatgttcacttaaggaaggagtttaggttaaatatatgggtattttgctaataactcagaagatacagctttttttcatttaaccaacaagattaaattagtcttacccttcaaaaaattacacaaaaatcattctggttttggctgggcttgtagttctataacctttgtgccaaaccctgacatttaaaaatatctagcagagacaaatataaaattgtcttccaagtataatgaggcaaaagggtatgctgacaatcttgaagacatttctacttttattttatcaataatttaaaaaccagcttgtttattaagggtttacttaagtcatgtgaacttgggaaatatttgtgtttactaatttatgaatgctcatttatttatgttgatttggtaccaggtagacataacatataatacatctaagtaagtgtaaacacatctaaacatacacaaacacaaataaagattgtacagctttcattttagaattttagttctttttttttttttttttttgagacgaagttttgctcttgttgcccaagctggagtgcaatggcgcgatctcggctcactgcaacctccgtctcccaggttcaagcgattcactggcctcagcctcctaaatagctgggattacaggcgagtgccaccatgcccggctaattttttgtatttttagtagagacagggtttcaccatacaaactcaccaatttataaaagacagctggatccaagttatatttctgacaaaattgggacctattcatatggctaaactttttttgcccctatgggtaatctaatgaaagctacagaccaaaagtttgggtaaagcagtttccatgtaagtttgatttttacaaacttcttttaccattttttataagtttcaaatgagttcaattttcaatgtttacattttacctgaaaactgaccaaattgcataacaaagacaaaatctccaagtagtcttgaaatagtaacaaatctatcttttgtttgctgatcttgtttgattagcaaatgcaggtggggaaaaatttttagcagtttctctcttttttgggggaggtggcactttttcctttcagcctttgtagcagaaaaagcaaaatttttgtgctagacacagatagatgattgctctgagctcaagattctgacttattagacctgagggcctaacttttctaaacatttatctttttcttttagattattaattgttcaattaagcatttcattttaatacgagtggctgaatctattttaccaatgccagtggaagatcgggatcataaatggtctggcaaagcttacaataaatcaattggtatcattcattagtttcagtttagaaaaaaacttgttggatctgtatttttatcatctcagtaatttcattctcatgctgtagtcctttcatttgctccttttgttccaaattcatacatttccctcttttgagagagaaggaaatgtgtgcattgtgaaattccaaaaatctctgcctaagaaatgtatgggagctgagggaacaagcagagaaggatgaggaatgaggagcagttggaggtgaaagggacaaagtctctgaagtctttttcacggcagagatagttgcgaatatccttttgtttacctcttgaatggaggcaattttttctttcaaaattttttatggaagcttctaggtgctattggaagtaagtcttccattcaatttgtctaattctaaatccagctttttccaattgtgtgcccaagtaaatcattttaggcatttcaaagggtccccattttgggtgttgctgcttatgaccatgccaagttaggtggatccacttatctaagcacttgcaggtaaaaggaccaaaagtattgtgcataaaaccagctggtgttgattagaggcagtgcactgtcagtctcagaagacctgctttccatcgtgattgttttgagtgagaccagctatgtagtggagcaaaagtgcccctcatgccatcactaaggaaaagtgctttcgccccaaacctccagggaaaaattcacagagctactttaccttgccctaaaattcaaacaaaaacccttaccttggattggtaagagggatactcgttctgagaaagacattgtattttctagccaaggagaaagccagcttcaaaaaaatcacaactttgaccaagacgggaagtttgttgatttcaggaagaactcatctgtaccacccagcaggggcgtccaagctcacaatgggtttgttgccaggatctgcatgaaggctggaagctgtgctggatggtccatggaggtcactccaaagcctactggctacaccataatgttgacagaaattaaggctgaaataacgtgataaaaggtgtattggaagccaaatgtgaggatcagcccaggaagacacatcaacaaagtcaggagtgttctagagtctttaacaagttggaaggcttttataagaaagcttaagagaagggaggggactcctcatatctgagttgtccttttcattggagggtatgatacagggcttataatcattggctacggattgcaacatacaggctgaaatgtctgtatgcaagaaaattagtaaaacttcttgattcagaaacagatcagcattttttcaatgtcagtaagtcatacaaataatcagccacatcaacaatttgaggaactcaaggtaagatactttactcagggacaagatgtcaccatgcatcacaagaccttcccccaggtgggttagaatttttgagctggttagaatttaaagccaccgtgctttaggaaaataactgtaaccaataagaaaggggtttgtagaaggtaaagattataaacaaaacatcgacagtggctgcttcaagtccaggtgaatgtgatggaggtcttaaattaaggcagtggctttgaagacacaggagaagttggtttaagttacatcacaggagtagaattgataacacttggcttcactttgtgtacaggcagatgggattaaacaatagtctatgttgtctggggtttttcgagacttgctcatgggtggagagatgtcaaattcagaaactgaaatggggagagaaacagattgtgaagtagaaaaccaaagccactttgaggaataagctactgcaaggtatatgcagagttcattaactaatagttgatattttgagtgcttacggtgtgactaaagaatcctaaacactctacgttcattatcttacttaaccaaaatccttaggaactctgtgagcttcagtactttattattattttaaaactcagaaaaaagaggttaaaaaaccttttactaagtcacacagctgatagctgatagtcctgagagctgaagtcagctttgtctagttccaaactaaattatttctagactgcatacataatccagctgtagccttggtcgctgcagttataagatagggctgaggccgccattccattactgagaaggaagccaccgcttcaaacactgtgttcatatctgtgagtccatcattacatatcacgtggttactcctggaggccactacatttgccctaaaatgaagactagagatgcaaaacattgagtcagtttagcctaatgccaaaaaaaaaaaaaaaaaaaaaagtgctgacacagctgagtcctggggaacgatctgtttcaaggttagagagaaccgagctgtaaaccatctggacgctttttcgatgtggctatttaatcatctttccactctgctctatagcatctatgttttcaggttttctctgactcagtaaatgcagtgctgggagcagcacccgagtctgtctgattcaaaattaaattattcttaggtgaattcagggcccagaggcaggctgtggccactatcattaacattatcgccaggcccaagggttctgtctttctcattgaccaggaagggagaatacaatcatctatttatgttaaatttgatgtgtgcacccacagagttgcacatagcatcctcctgtaacaatcttttcagtatttgtcttttgttgatcattactcatcttgtatatttagggttttttttcattatgagtttcatgaggaggttgtattcaaaaaagcctctgggtatatttatgctttctaccattcatttcccttccattacttgacaaattgggggcattctatcattttatatctcttttttccctaacaaccaccttttcttctctgcatttattatcacatatgtatttatctactacaggaaaaacaaaccaatcctttagttagatatgtatctcctcagaaacatgcctagaattttatataaatgggatcatcatacatgtagaccaatatttttaaagtcagcataatgttatttaaacttgtgttattgatataactggtagccccagataatgcaaaaggtgaaatactgtatatacccatctctctagtaagtataaaagttatgagcaaaatattaacaagtggagttcagctgtgtaccaaaatcataatatgctaaagtcaggtttaatgattacaacagcatttaaatatcaggaaatcaatcaacaaaatttattagaactacaaaatgatagaaaaatccttatgattaagtcactaggtgctgaaaaagggatctgataaagtttatcaacagctcctaataaaaatccttgctaatgtaagaataaataattgcttaaatatgctaaaggttgtttaccaagaaccaaccatcagtgaaaaccattctaaatgacaaacaataaaaccatttcaattatagccaggtatcaggcaagaatactcaccatcaccattaatatttaatatgttcttgaagaaagtgcaaccaaaccaaatgattcaaataagaactagaaaatagaagaaaaaaagacaacttttttctcataatagaattttatttctgaaaaacctaacatatattagttttaatatacaccatggaatactatgcagccataaaaaatgatgagttcatgtcctttgtagggacatggatgaagctggaaaccatcattcccagcaaactattgcaaggacaaaaaaccaaacaccacatgttctcactcataggtgggaattgaacaatgagaacacttggacacaggaaggggaacatcacacaccggcgactgttgtggggtgggggaaggggggacggatagcattaggagatatacctaatgctaaatgacgagttaatgggtgcagcacaccaacatggcacatgtatacatatgtaacaaacctgcatgttgcgcacatgtaccctaaaacttaaagtataataataataaaataaaatttaaaaaaatccaaatgtcaaaaaaaactaataagaacatatcttaatatggctaaatacaagaaatatattatgaaatcaatagcttttctcttcaccaatataaataccttgaagtgaaaatggagaaaatattccattcacaataagaacaaaaatataaaaagacttcaaataaatctgacatgaactccagaagattgaacaaagcaaactataagatcttgttagaaatttgaaaacattaaaaaaattgtataatattaaataagaaaacaatatttaaaatgttaattatttgaaagttgatatcaaactttaacacaatcctaattagaactctgaaactgctttagtgtaaacattttgcaaaatgatcttgattgtcatatataagaataaacacctttgtgtagccatgaagcatttcaaaatgcatagtaatgtatactcttttacctgcagtgaaaacacacaagaacgacgttatattcaactcaatgacaataatagctaacgctttgaatacttattatgtaccaggtattgtaattactttattaaatttgtgtatcaattatgaggtaggtacaaatattatctacactttacagaggcataaaaaattgagaaattttcagcatctctcatagtgaatggtataaacaggatatgaatcacagtctgtctgaatccacagtccaagcttaaaactatcaaattttgcatagaagtagcaaagagagtgctgaaaaactggagaatttgaaagaagcttccaatataaacaagtatttgacatgagaaacactagggatagggtgacacacttagaacacagtgctggcataactaactcttcatctacaaagatgtaatgtaagtctcattgtacaaatacacaaaattacgttccaattggattaaagccttaaatgtttttaaaagtctataatttggtttcataaaaagagagaaatttttaatcaaaataggaaatcctgaagctataaaagatagccatatttaatttgccatatatgattttaaattttaattttaagaaaggcaaaattagtagacaaacaatggaaaatatttacaatccaggtaacaagtaaaaggagtatatctacaactgataaggaattcttccaaattgagcacaaaaagacaaataaataatagaaaatgaacaaaaatattttagaattagctcaatcaagcctgaaaccaaggcctgctttgtttgggaaattgatacatagagcaaacgttcaggaatgtgttagatgtttttttgcattcactattggcacttggtgagaaggtagacctgcagctcaaaatttgtacaactgctacaggatcccttgaatttgtaacagggccactcgttctgagaaagacattgtattttctagccaaggagaaagccagcttcaaaaaatcacaacttcgaccaagacgggaagtttgttgatttcagggagaactcatctgtagcacccatcgggggcatccaagcttatccaccagataagtggagccacctaacctggcatggtcacaagcagccaagtccaaaatggagactggggtggtcagaaatgcctggaatcacacctaaccatggcagtggtgagtttctcaaagagaaaacaaattctcactgtctccggcagcatcgttagcaattgaccctccatcaaggaatgtgacccggactaatttctaagtgtaaaagttgcattctttgctggtttcttttggtgttattgcgtatcagccccactgttgccactcttgtaacagctgaggatgtaatcattcatttcttcagcaaacatctagggagcatctctattataacccagtcaccgttaggcactgggaatagaaccgtggcaaaacaaactaaaatttgcttcttggcatctggtcctggccatgagactataagaggattggaattaccctcctaacataaacaactataaaatgggataaaatgtggagagaaaaatcagttttcatgtattggacagcaggcagtgcacagctgtgatccccgagaaaagaaaaacaaatgaatgaaccatgccatcccgtgggctttctgcgtgaatgctgtactgcagcacgaaggggaaaaattcaagacctgcagtcttgccaagttaagaagacagaagtcagagttcaagaaaagaagatggctacagtttatgagatggagtacccaaaaggaggaaactagagaatactcacaaaatctatttaagtaattccttttaatggcaaaaccacaattactttattattattattatactttaagttctggggtacatgtgcagaatgtgtaggtttgttacgtaggtatacacgtgccacagtggtttgctgcacccatcaacccatcacctacattagggatttctcctaatgctatccctccctttacccctccacccccccacaggccccagtatatgatgttcccctccctgtgtccatgtgttctcaatgttgaactcccacttatgagtaagaacatgtggtgtttgaaaaaccgcagttacttttgcaccagcctaatacatagatttccctttgagacctcggttaattattgacctttatatgtgaataatgaaacaccaaaaggcagaacaaaataaaactccaaggaaataacaattacagaactctgttagatgaagtattcccagagctcatatattgtcaggaattatttaagtttattctaaccatgagacattaaacagagaccccaggaaagtagtttcttaggatgaggttcaattagcactcaaatatagtcatgtgtcacataatggcatcttagtcaacaatggatgtaggacattggtcccctaagattataatatcatatttttattgtatcttttttatgtttagatatttttagatatacaaaaattaccgctgtgttacaactctctacagttttcagtagagtaacatgctgtacaggcttggagccttggagcaataggctatgccatatggcctaggtgtggagtaggctgtaccatctaggttcgtgtaggtactttctgtgatgtttgcacaatggcagaatcgcccaatggtacatttctcagaacatatcagatatattgttaagtgatgcatgactaatggccactatggaataacccttaaaacatcttttttaaaaaccttgaataagtcaggttaatccacaaataattaattgcctgtcataaaaagtccaatattctttgaaggaaaacaaaaagtcctaaattcaacaagagagaattaaaaatatctggtgttaatttaaaaataaaacatgatatatgcaaaggagcagggaaatgtgactcctaatgaggagaaatatcagttgatagaaacagaactcctgataacaaagataagggaattagcagaaaaacacatgaaaactgctaagataaatgtattccaaatgctcaaggctataaggaaaaccatgaacatgatgataagagaaattaaagattataagacacccagataaaatttccagagattaaaaaaaaaaaaaattctctagatgatcaccaggttagataccacagaagaaaaaaaaaaaacccctaaattgtaagcagtagcaatagaaaactatttaaaaccaagaacaaagagaaacttgaaaaaaaaaaaagcctgaacagcatgtcaataagctgttggacagtataaagtagactaatatacctgtcattaaagttccagaaagtgaagagagaaaagaagataaaacaaacttttgaagaaataatgactgaatttcttccaaatttggtaaagaactcaataaactccataaagaaaataataacaaagaatatgataatcaagttacttaagatgagtgacaaatagaacatcttaatggcagccaaaggagcgagacgtgtttggaagaacaaacctaagaaaacagctgactcttcaacagaggtgctgcgagccagaggacattggaatgagatcatttaaagtgctgggaggcataaaacactgtcagtctacagttctacacaccacagaaatatctctcaaaaataaacattaagaatttgtataggcccagctactcaagaggctgaggcagaaggatcccttgagcctaggagtttatggctgcagtcagctatgatcacaccactgcaccccagcctgggcaacagaatgagacctttttctcttaaaaaaaataatatatatagatatatatataaagatatagatatatataagatatatataaagatatagacatatataaacatatatatataaagatatatattttcagagaaaatcagacagtatttattggccataaacctatactatgagaaacttaagggaagttctttggagtaagaaaaattacaccagatgaaaagttacatctacatgacagaaggaggtgtgccaggaatgataaatgttgtcaacatatggccaggttttgggtggaaatttttgtagaattagttaactagttctttaaaatatccttccttttctcaaagggtcctttaaatataataaaatatgtccagctcctctgaatgtaatctcatgtaagacttctgtctgaacctttgtcctgctctaaacactgacatggaaagtgaaaatataaacacataaaacctttggaacatgttagaactttcttggacaatagtggcaataataaatctgatctaatatagggtggactataactgacagtttaaaggacagatttcctatatcattatgcctacaagctccccttaatactcctggaggattttatattttgtttaaaaggaaagatccaattataagctatctatgttatctaattttaatataaagacatagattaaaattaagtgaattttaaagctgggcatggtggctcatgcctgtaatcccatcactttggaaggctgagactggcagattacctgaggtcagagttcgagaccaacctggccaacattgtgaaaccacatctctgctaaaaatataaaagttaaccaggtatgatggtgggcgcctgttatcccagcagctcgggaggctgaggcaggacaatcgcttgaacccaggatgcagaggttgccgtgaactgagatcatgccactgcactccagcctgggtgacagagtgagactccgtcttaaaaaaaaaaaaaaaaaatgaaatggattttaagagatataccatccaaaccctagtcaatgaaaatcttgaatggctatattaatattagataaaatagacaacaaggaatattaccagaaataagaagaaatatttcataatgataaaggagtaagtttattaagaagacttaagaatcctaaagatgtatgcagctagcattgagctacaatatttgaagcaataattggttgaaccaaaagaagaaatagacaaatccataatttaagttgtagatcccaacaatcctctctgagtaattgatagactatgtaaaaacatttaataaggatacggaagtcttgaaaacactattaaccaagtcaaccgaattgacatgtgtgcatcacatcactcatcaatagaaaaatgcacattcctctgagtgcacgtgaaacattcaccagagtagactatatgctgggccattaaacaagtctcaatatattgcaaaggatggaaattatacaaagtatgttctttaacagaaacaaactagaaatcaataccagaaaaaatatctggaatgtatcttgataattggaaattgaacaacatatttctaaataacaaatcagccaaagaagaaactgaatgtattttaagtgaatgaaaataaaagcaataatatcaaaatttacggtatgcaacaaagcaatacttaaaggggaatttatatctttaactgttcatattagatctcagctttcacttcaataaactaggaaaaaagatttaaaaccccaagtacacagaagaatagttaggagcagaaatcaactacacagaaaacagaaaaatgttagaaaaaatgaccagctgttttttggaaaagatcaataaaatcaatcaagagcaaagataatggaaaaaaaatcagacaccaagcaaacatattaataatttggacaatataaatgaaacagaaaagtccttgaaagacacaaagtattacagttcaccagttaagaaataagtaacctgaatacctggatattggtgtaataaattgaattcgtagtttaaaagccccacatattaaaactcaaggcccaaattgattcacttgatcaattctaccaaacatttatgtaagaaatagtaccaattctgcacaaacttattagacaaatagaagaggaggaagatatatttccaaaattcatttcttagggcagtattaccctgaaataaaaaccaaacaaagaagttaaaagaaaataaaaccacagatgacattccctcatgaacacagatgcaaaaatcctcaacaaaatattagcaaattgagtccaacaatatataaaaaggggtaatacatcacggtcgaatagcttatcccagcatgcaaggttggtttaacattagaaatcaaacaatgtaatttaccatattgacagattaagactaaaaaagcaaaataacataatcatctcaataaatgcagaaaaagcatttgagaaaattaaacatacattcattataaaaactctgagcaaactagaaatagacaggaatatcttcaacctgataaaagatatctattaaaaataccataaatatcatacttaatggagaagaatgaaggctttctcctcaagattagggaaaaaagcaaggctgttcactctcactacttctactcagcattatactagcagttctctagagtgcaataaggcaaccaaaagcaataaaaagtgtctagatagaaaagaaaggaaatacctatatacacaggaaatatgattttgtagaaaattctaagaaatatacagaaaatatctaccagaacaaataattacatgtatcaatgctacagaaaataaggtcaggatacccaaatgaattttgcatattagcaataatcaattaaatatttaaattaaaatatacatgtacttttatatgtacaaagcatcaattatagtacatccttgggaataaatttacaaaatatgggcaaaatctgtattctgaaaactgcaaaacattgctgagagaaattaaagattaaaaccatcttcctttcaaggtgtttacactctaatgaagaaagcaggcaatatttaagataaataggttaaaaaatataaaatatgtattaatatgattagacctagagaaacaaatcagagaaaggggtataaaaagtcggaggcaaggcagttaatatctagatatattagctattgaaggacatggaaggcctcacttagaaggtgacttgagataaaagccaaagaaatgaaaggttgagagcatttcaggcagaagaaagaggagttgcaaaggccttgagaatggcatgtgcctggcttgctttaggatggacagagactggcgtggctgcagtgaagcagatgggactgaggggagaatactgggagatggatgcagagagctaagagggaactaggtccagcagggctgcctggtcagtcaggactttggcttttcccacaggtgagatgggaagctgtgggagggtttcccaggggagcgatgtgatttacatatttgagagatggccctggccgcctgggaaagcaggtagaaggccactgcagtacctcaggaaagaatgcacataccttagacaagggtaatggtggtgggaaagagaagaaatggttccaaacctattttgaaggtaaaccaatggtattttctgaccacctagatgtagggtgtgtaaaacagagggaaagagaaaagatagccaagagtttgacctaacaaccaagctaatggggttgccactatctgagaagaggaaaaaggttacaggagctggaggtgtgggagtggagtagaagggtctcagcttattcccattgacttgaggtatccatttgacactcaagtacagatgtcagggaggcagttggccagacaagcctgaagttcaaggtcaggtccagtgcgggttcaggtggtctgggctggagacatgaatgttggaatcctcagccagactgcgcatggtttttagaaccatgagactggataacaccacctaggaagtgaggagatccaaatatcaatccttgagcactccaacattcagagctcaagaaaacaaggagaagcacaaaatagcatgaaaagaaccagcgagggaggtaggagaaaagcaggtgatgagtgtccgggaagccaggtacagtcagggcttcgaggagtagagagactggtcatctgtgtcaagtaagaggacagctgagaaattatgacatttagcaaagtgagtctctgataaccttgagaagagtaattgtggttgagtggtgggggtgagagcatgacaggcaggagtttaagaatgaataggaggagaaaaatggaagcatggagaatattttcaaggggaagtagacagacagttttctaaagataaaatcaacattgtctaaaacgtggatagtaaggatcaaatgtatccataagcagggaaacaaaaactaatgaggcatgtttacatctacaggagggtcaaaattggagaaaaaacaccttatgcttccagagaagggaagaaaacatgcattcatacatctgtagtgggagtgcacattccaaaaacatttttgaaaaagaatttggcaatacctatttaattttaaaatttgtaaactgttcacttcacccgtggatatctattctatacaaaaatgtgaaaaccacacatatatcaacaaagacatagattgggatcttcattacaacattgtttatagaaagagctcactagaaatgcttataatctatcctcattattcacagcttctatatttccaaattcaaccatgtgataaagtgtacctgtgagccccaaggtgataatcacagcacttttgccatcgttctcaggcatagtggcagaagattcgagttgtccaatgttggcattcccaactgcagcagaacaaagcactattctgctttctcatttcaactttcatgctgtgaacaactgtccttttctgttgttctatttggtgctccatttttttgcatgtttgtaacttacactggtgatctcactgttgaaagtgggtcccaggcatagtgctgaagtactgtatagtatcactaagggcaagaaggctgtgaacgccttatggagaaaatgcatctttgagataagctttgcttaggcacaactcatgggttgttggccatgagtccaatgtttatgaatcaacaatatatattcaataaggtgtccttaaaaagaaagacacataaaacaaggttatctattgatcatttgactaaaatgtttagactagaggttcaaaggaagctaacgttgagtctctcctagaagcaatggttcagtatccactagttgcacatgaactagtgttcatgatgactttatagaacaaagcaaccataaataacaggaatgaattgtctccctttgttgagaattgtgtgagtaaattaaagtatatcccaaggtgtgcaccatgtgatattacgagccctttaaagatcactactcaatcaaaggaacccaagtccttggagtcatttccttaaggtactgttgcatgagaaaactaaggtgcagaggaccataatatgatgtcactttttttttcttttggagatggagtgtcgctcttgtcgcccaggctggagtgcaatggcgcgatctcggtccgccacaacctctgccgtccaggttcaagtgattctcctgcctcagcctcctaagtagctgggattacaggcatgcaccaccatacccagctaattttgtaattttagtggagacggagtttctccatattggtcaggctggtctcgaactcctgacctcaggtgatccacccgcctcggcctcccaaagtgctgggattacaggcgtgagccactgcgcccagccaatgtgatgtcatttctaacctttgtcatctctctctgatttcatgtggttgcctgagcatgcatagagtgatgtccaccaagtcagcaatgtgggctctgggggtgggtgtgggtatctgtggagcaatgtgcttgcagtgcagagggcaggggcaattaaaagaaaacagcacagttgatggtatcatttatgtcggatgatgtttgtactatgaagaaatttgaaggaaaaagtcacagttagtcttctatgtactgacttgtagggatgaccatgttggaaaaagagcaagttgcaaaataatgtgtgcaatgtgattctattctagtaacaactctgcttattatatgtgtcttagaattagtgagaaaaaggtttctaaacatatcaagaggttgagagttttgtagaaaagtttgctttttaacgcttatttctttttcttttcttgctctctctatttttttttctgagatggaatttcactcttgttgcccaggctggagtgcaatggcccaatcttggctaactgcaacctctgcctcccaggttcaagtgattttcatgcctcagcctcccaagtatctgggtctacaggcatgcactaccacacctagctaattttgtattttttttcttttttagtagggatggggtttcaccatgttggccaggctggtcttgaactcctgacctcaggtgatccacccacctcggcctcccaaagtgctgggattacaggtgtgagccagtgcacccagcctttaatgcttatttatattggcttgtctcagtaagtccaataagtatgttttgttgaaatttgaaaaaaaatacaaataaaatatgaaaaaacatcaattagctaaatattattcagctaacaaagaaaggatatagccattttaatagctaattaattttgaaaatggcaccagcagatacaattttattataagattctgacttgttgtatgtaatgctttaaaattctttgtctattttttcttttaggaatcattaagagccatcagatatgaaatatctccagatagagagtatgcacttttttcatacaatgtggaacccgtgagtattatcctttactgcctacaaaataattgtttctttattctaatatctcattaagtatatttccttgactcttctatacttagtgatctttgaatccagaaatactttgtacatcctggaagtctcttttgcatatcatactgccacctaggagagaggaaaggtataaatatctgcttggcaggggaaaaaagtcacatactttagaggctctttcatagacttttcttaggaggatggtaagaacttgtctcttcatagacacaaatcttgcccttttgtgcaattatttttctggctgttttctcagtgaaataatagattttatcctaagaacaaaaagcaactgccaggttctccttaaactgaaataatatgttaattatctcctggtcattgtagtgttctagtgaagagctgaagctatcacttccactatttaaatgcctatttttagcacttcctgtatatatgagcctcccataaaatttcaccagaattttctgtaaaatctcactgtgtattagtagcagtgtaaaacttcctaggccaggatcttccttcttcttcttgttttttcatttgacatgctcgtatttcaaatttcattttggctctttaattttaaatagttggaaggtgaagtttatttgtataagtggagaggatgttcagtttacaagagataagcaactttagaaatgtatgttttaagaactttcctctctggcaaataagatatagagtctactactgcctccctggcatttctgagaccatttgaaatagagtttcctggtgcttctgtgaggtgtaatgactcctgcattttaattcaggtcagaatggctctgtggtgagtttgagagaatcttttctggcatgagacagtcaagctttttggtttatatccactgggaaagctggggtattggtttgtatgaagatgcaagttcaattctgaattcttaaactttcttttagaagttgattggacaactggattactggagatttcaactttattcttccaactgtagatttttttggactctgtttcagtcttccatttttctatttttaaatgtccattctataaaggttttcattttttccatccaaattctttgaaacaatggggcatctttgtctctttgattgggatcagttggtgaacttgacattctaaaaggcttgggactctgcattacctagacacagccttaaacttgcctctttcagcctcaggcacctggatgtgatgttcacgggtcatagaccatttcagcttccttcatcacccttgaaaaccaccagaaatacaatctccacacctgtataaaagaaaaatgttagcagatatttgaaagccttacatggatgtgttctggtttgccccaggaggcacagctaacacctgagtgagaaaagcctagaaagacaaattgatttcaggttatcctcctagagaatctttaatcatcggagcaccccgacagtgggatggaggtaatgagcattccgttcccagaagcctcaaaacaaagtgaggtattgttctccggaatgtgacagaggggttcccgcagccgtgtgatcggaagaggcgtgctctagtcagtggtgctgtggttctgtgcatgatacaattctccaccactttcttcggcttcccagcgctctgtttggaagagtgccctgggatcccattgaaccagaaaccattttgataaagatcattttgctaaagatgagtcttcaccatgtggagcactggctgtaaacaggaaccttgaaataaccctttctcactgggcagcatctgtcggtgtttggagtaagactcttcagtttgtcttctcaactgaaggaaaacctaggaagtttgaagtgtatttacagaactataaaaatgataaaattgaaaatgtaaaaagtctatagaaacagatattttaagttgaataaaataagtaatccttaatagttttcagcactgagcagttactgtatacatgactattcaagcaagtattctctgttcttctggaggaaaaattataagggaaattataacctataggttatgagtagtgtgtcttctctctgaactccttagcgctataccaagatacaatccaagttcttgaaattctatcaaatccacaaaatatgtaataaaaggattacatatgggattctgcatgagaatttggagttagatattaggaagatcttcctaactagataaactaaaatgtaagtaattttagaaaagggaggggtaaatttcaaaggaagagtctaggtctgtgattctggaataagtggaatagaccaggacttcctaatcagtatttagtatcagtaattgttattgctagtattgtattaatagtataatcaattaaaaatattatccattggtattctttaaaaacaattaaaggttccatattcaaatacatttgagaactctagttaaacagataagtttcttgaagttcctgatattctcatgttggttacatagtacttcccaagtgggtattacaacatgtgattccaatctaattataatgaaactagaatttgttatttggattcatgctcaacatattcttatgtgtgtatctcaaaggcagctagtgtaacttgtttatatgaaccaactcaacttttcattaaaaagactatcataaaattgttttagtgtaaaccaactgtccaattactagatatctgtcatttatttcagtatatgtttcatttgcaataaaattttggtatattgggttaccactgcactaaaaaaaaaaaaaaatcctactatcccacatttcgtcaggataattataatctcttcaatctctgcttctctttgttgcctgcccaaagatactggacttggaagtcaaataatcataggttcaagggctcattccgatgctcaccagctatgtttgcttgagtaacccactaaaccttatgcactgcatcttggagccatcttcctgggtgaccctgggcttctgtttctcagtggtgaagggcgacccaatgaatgtcagctctcctacacttccagggtatatgtgtttgagcacagagtagttccgtatgtatacccagggccagatttaaggctctatccaatttcattggaatggagttgatggatgcctacatgaaatcagctgtcttggcagtggctcaagtagaagtgagtaagagctttccagcacagcatgggtggtaagagaaatgaggaaacagatcattaaggagtttagacacaaatagtacagcaacatcctgagaataagagttgaaggaaagatgtttaagtttaatttttagaatatgcattgggtatctcttcttctcatttattcagactaattgcaatgttatatcatttcccagttgtttggcatagactaatttaatttgtccatttttatattgtcagatactcaaagacagggacaggtctttttatctcctatctgtccccacctcagaggacccagcacagggtgatctgcgtacatttagtactgagcaaatatatttgtggtgtgtgtatattctctccgaaccccttagcgctataccaagatacaatccaagttcttgaaattctatcaaatccacaaaatatgtaataaaaggaaaatacctcagttgtgaaatatcctaataacgttccatgtttattctagaaatgtgggatcatgctaattagcatgctttttcctactaaactcttctaatattactaaatgtatagcttggctagcatccttgaacatacacaagttagctcatcttaactatgccaaccctatgtttttttgagagctttaaaagtagcctttaaaaaggtgtttgaaatatcaattatcaagtaaatttgagaaacagcaaacccaattttccactttttcaagcctcagacacctataggttataagtagtgcatctggaatgttgaaaataataaacagtattgtgtttgtatttatgtggcaccagcattatagtttgcaatgtgtgcttatttacaccaccttattttatctcaaaagatcattcctgctccaaagagacaacatgtgctaaatgagttttattttattttatacataaaatttcataacatttctcagtgtacacttcctgaatattctcttgaaattaagttagacattggagaaatagcaattttttatttttaatttgaaaactgtattaactatactaataaagaaaaattgccttaaaacaaatgtatctaattagagcagccatgcttttttatattgagatatatttgacaaatatgaaacatttccaaatctctttggggagagggaaaaagaatgtaaaatgcattatctaagatcatttaaaaatattaatactttttcctactaaactattttaatattactaaatgtatagcttggctagcatccttgaacatacacaaattagctcatcttaactatgccaaccctatgtattattgagagcctaaaaagtagcctagtattaatatcttagatcatttaaaaatattaatttcaaagacctaagagaaaaatattcttccttgaagaatcatttctgaaagagtcactgaagatttgtgaggaatttcattgcaatatttaaaggagttagttgaaatgattgttcttagtcagatcattgccagtggaacatcattctggtccaaatgaaattctgtccaaaatctggtcagattttaagatttttttcctaaaatcccaatcacacagtcattcagtcagtaaaatgggttgatacactgatctgtttataaactgttcatataactgaaacacataaaccaatccgttttagttacttgccactgcatagcaaattatccccaaacatagcagcttaagacaaacaacatgtatcatcccagtttctgctggtcggaaatctgggctcaagttagcaggatccttgcactcagggtcttctataaagaagactgtggtcaaggtgacatccgggctgcagttgcatctgagagctcacctggggaggagtctgcttccaagctcagggcatgggtgttgacagggcccaaatgccatccttagagatgggttctgctcagtcctgagagaagatggtttgctgctgagcttttcatggcaggaattggaagcagttttcatatttgataaatttctactattttcctgccatcgtggtgagttgatagagcccattttgctctctaagggactgtgaaatttataattcatataaagcttgaagaacaccctgatgtggataatcctgatcaaacctgcttggtgaggtgaaccccaactatatcccagaatcttctatgcacccatctggtcgagttacctatttatctatatcttaattaattttaaaaaataacttgaggctttataaatgtaatataagggattgggctataaattattgaacccatattgtggactaaattataactgctggaaatcaattcaggtaattctgagtatatgagtttctttttttttcttttcttttttttttttttttttttttttttggtggtgtctcactctgttgcccaggctggagtgcagtggcgtgatctcgactcactgcaacctccccatcccaggttcaagagattctcctacctcagccttctgagtagctagcattacaggcacccgccaccacacatggctaattttttttttttttgagacagagtctcactctgtcacctaggctggagtgcagtggcacgatctcagctcactgcaacctccacctcccaggttcaagtgattcgcctccctcagcctcccaagtagctgggattatgggcacgcaccaccacacctggctaatttttgtatttttggtatagacagggtttcaccatgttggttaggctggtctcaaactccttacctcatttgatccacccgcctcggcctcccaaaatgctggggttacaggggtgagccaccacacctggccaattctgagtatatgagtttctttgttgcaagaaatatagctattgttataatatggttctgatgtttactgccatcccttcttcattacaagaagggatgaaatcttcgtccaggagtggctaagggaattgtgtttcttgattctcgtgctcttggactggttctttctgcactgtctacagagcctttcctgggcccacctctgggaaccagttgatccaagcgttttctgctggacgaaggccttgcacattctcatgtgtgggggctgctatcagaattgcagggagctctctgtctccctctgcagtggcctcagagggcaaactgaagagcagggcctgcgtgtgccatttctaccacacctgccgccctttctgcatcagcccagtagctgctgcagcagcaggaggcgagtctcaccttcagcacgttctccttctgagaaggcagtggatgaacagcctgtccaccacccactgagaccagaagctgccccttcactgcctggaagtgcatcctgcacccatcagcatcactccaagcccttttatcccgggatgaattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttttaagtagaaggagcgtaacagtggctaggcatcactccataatctagctctccacctgagcaacacgtgcagagcttcaagaggctctgaattctttctggctgccagagataaccaattatacaaagaagaaaaatctgccaggtgcagtggctcatgcctgtaatcccagcactttgggaggccaaggtgggcagatcacctgaggtcaggagttcgagaccagcctggccaacatggcgaaaccccatctctactaaaaatacaaaaattagccaggcatggtggtgggcgcctataatcacagctactcaggagaccgagacaggagaatcgcttgaacccgggaggcagaggtggcagtgagctgagattgtgccactgcactaccgcctgggcaacaagagcaaaactccgtctcaaaataaaaaagaaaagaaaaagaaaaatcttatgttttcttactcttggaatgaagaaatatgcaagtacgaaaattcatgaggagattcggtaggtatctagctctgattaaatgatttattagaaataagaattagtgaaatcaaccactttttaagttacaaaatattacaatgatcagttttaacctcaccccctgccctgaatgaactaattgtttttcttagagccaggtaagggcctgccattggcaagcttgcaccttgagttagggttagagttgtcatgagtcaaatgccagccatgtcctcttctgccccccatgggggggcccaaagtgcaggagtgacagagaggaacagaggcagatgggcagcagggagatggactggcaggtacctgtgtcctcacaggtaattacgtgtcattccctctggatggtttctgaactgtgggaactcccccatgtgcattgatgggagaagagccaggcagagacacggtaaggagggcaagttatccatgtgaccttagggatacttggggcaaaagtaggctaacctccgtgcacaccctggaacaaaatctttaaaagagagagcacagaagagagagagagagcactttgcccggaatgagccccataatcagacaccacatctcccaaattagcagcacccttggtttctgggcaggctgagtttcccgcgcgtcggaggggataggatgtagcggtgaataacagtaagactccaaaatcaagtgggtatgtctgacgatctgcctctctctcccccttacacacacacacacacacacacacatgcacacatactctccctcccccttacacacacacacatactctccctcccccttatacacacacacatgcacacacacattaacacacacacacattcattgctcttagtatatttcctccctacctccttaactttgaccattgacaaatttttctctcttaagaagtcttgaggcagtgcactcgggcataactcccttccttgtgatacatccacgtctttgtgaatgatgaatggaacgttgctcacttgttagtaattccaacagacaaagacgtggcctgagactgcccctcacctgctctataatggcttcttgcagcctgctttcctccctccagcgctgccgttagagcctgaggggtccaagggagtcagtctgcccccgtgagtcttcatgtggtgtagatgatgtcagggtcagaaactgacattcaacacgagctgaggcccatggtcccaaaaatgtgtgtgagctgtagttgtccaaagacgtgagaggacaagaggcttgagtcagggaaggccgacggagaagaaagcctggaaggagaggaggatccggggtgaagaagagaggaatggggagaaccttcccggtgcgatcactgcagaggaacagaggccgccatgggaaacacctgcagcgagcatcagcgaggagctgaaagtgctcaggtatcaaaagaaggcagaagaaagagcagcaaaaaggagagaaaagtcaacataaaaatttaacacgggtcccttctgctgacagaagccttcccagtgcctattgcggccaccttcctaatgtgacctcagatccaaatttagaaacagcctctgttccctccgctcccagactgttttttctgcttgccctgcattcatttcttggaagttttttaagtatataagagcccaggttggccagggcaggggttagggaagcaaaggaactggaaacctgtgtccgctgaattgcagagcaggaataagggactctgcagaaaagagcatgacaaagagccgcggatacaagcgagggtagcaggagaaagagctaagaaggcagaggttagttgtttgatcgtgcacttggggaaggtggagggagaaggggccgtgaagagatggaacggactggcagaggagatttgtgtggggaaaaggagacagaggggacaggaagaaggggacagaagagtaaagagcctggaagggccagggaaccctgcctgccatggtcctcccccacttcctcccacacaccctgatgcaactgtgactgccctggcacctcagcagcttcagaacagggaaaggaggagaacacgggtttcacaggaggagaagcaaggaggacccagggagctggggtgccctgtgattctcaaccctgtccacatgatctgacctgggggatgagagcttattagatccaacttgagttgacaacaaagaacttctggagcctttcaggcccttttgaaacaggcagatcttctctgcagtcatgtctaatgcagcaaagaaaacaacagtgtcccctgcaggtgcagggacttctggcctgagacagcagaataatcgctcctggagtgggaaggttggcttgtgtattgtgcgcggccatcagcagcatctcatttcagactctctcatatccccggaatgtcccggggttaccgaaaaggccccattctccttccacctgccttctcctgctgctagaaaccaggatttttgactattgtccctgcatccccacatgtcacccagaggcagccttaggccccctgtcctgggccacccttggcataactggagtagacccgggtgcctaccacagcctccttttcctcaagggcagctgccctctcggtgccctgctcactgtgagcaaatacatatttaaagacatattctgctacttcccaaagggaccagccaccacctgcactcctcgtcctggtggaaacagtctgagtgcttgctttggtaatcaaaggtttcattgagtgcagatgtagtgatcctggcaaaaccctggaaacagaaagtcagctgaaggggtgtttctggagatgaggaattgtgctggttagccacgggcatgtcctgaggataattatttgtttacaacatttctgtgaacaaagaacatatagggacagaaataagttagtttccaagaatcttgtgatgggctccatttatctgacccattgggtttgtagaagaggacagaatgctgctttggttctcctccttggacagtggaactagagaacgggaagctgagatggccgagctgagtggacagaggagggaggaagcccctcacctcgcctgcttcccacagggtcccttcctcctcctcctgtttcctaagcttctcagctgggcttcagatgtcaaggtttcctggcttctgccacttcaccttctcatcttagctgccactggaccataagcatttcaggttgctcagatctctcccaccgcaaaataaagcaaagacaaaaaagttctctctctctcaacccatacccatgtcctcctctggttcttcccttcacagtcaaatgactaaagaaagaagcagctgcactcacctctctgtcccctccccactcactcttccgtgtgtctcccacagagtggaatgagtgctcagggctcagccacccagcccctggggaacagtatgagtgtcttccccatgttatacccccgggggaaggtatgagtgtcttccccatgttatccattaggagacgggctttgggagattgcaaggtttctgcagtgccagggatggagggctgtggttccaggtattcctctctgcaaacacctgctcttgatgggggctctgctgcccctgagcccactggtaactgtacttggcccccaccacacagcaaaactctcacccatcttaccagcagtcttctcgccctggaattcactggtgcctgttttaggctgcctgggctgccatggcaaaataccacagactgggcagcttaaacaacagacgtgtgtatctcagagttctggaggctggaagtacaaggtcaaggtgccagcaggtcggtttctggtgacggctcacctcttgtgtaattttgggtggacacaaacattcggtctatgtgccaatctcctcaggcctcctgtggcagaatttgaggccgctcacccctccctcttcctcagtccttggttccacaggccctggctgccctctggctgcctcctggccacttaggaggtcctcaggtgctcagacttgattggatttcccagtcccacccaaggtcatcttctcttctcttgcgcactcaccctgggcaacttaacctactacggcaactactgcatcggctgctgccacccaaaacgcgatacactgagtggtggcagaagcctccccaggaagcctgttagaaacactgactcgggacccagcccacaccctgatcagtcagaagcctcgcgtggaggagatctgcatatgattcgtgcgcacactgctgagacacatgaacctcaacaacaaggctcccgcatcacatctctgttctggacctctgactcgggtgtcagacctgtgtgctgctgtctccggggaacgtagagggccctcagacacagtgtgtgcaactgatctcatccgtttaatcccacgttggccccacgtcctgcctgcaacatcagcactttaggaaaaacaccattgtcccctccttaccaggaccctggctagagaccttctgtctccctggcccaggcagcatcgccatccccctgcctttgggatatgtcccttccacttccccattgccactgcccagttcagcccaccttacctgttatctaaaaaaccacctctgcctccagggcctctttgcctcagcctccccgccccacacttcttcaatctgtgctggccacgctgccttcagggtgacctttctcagtgccaatcaggtaactcattcccaatctgcacctcttccctaacccccttgctgtcccacctgctccttccctctcacctctgggcctttgcaggcgctgttccctctgctgggagcacctgcctcctccactgacctcacagttctcccacgcccttccagcctcttcagcagcaggccttggactccacaggagtgggctcccatacccgtgcacacccacggggaccacagcactgctgacggttttccgatttcctgcctatgagtccccgcactccaagggactttgagatgcttaaaggtggcttgggacatggctgatccacaatagagcctcgagaaatatccgacccattgcaaaatggaccgtcccccacccccatgcggtttcagggccgctcccaggctgtgagtgtttatgtgaaaggagtgtttgccacgtcgctcgggacgcccatcctggcaatgagcagctgcagcttccaggattttaccttcttaaatgcacttctgttaagctgtgcatgtaagaggtctgttctgttgaaatatttcccagagactttcatactaaggagggctttattgttataaatatttaaacctgctttgcagccagtcgctacgattactcagctcagaaagcatgcacaaagcctgcctctagtggacgatcctgtgctattcatcggcctctcattttaaatgtcttcctgatttcaatttaaaagcgtatctttatataacatatacaatttaactttttctttttaaaaatatgtatagctagtttttgttgtgcaattctatgagctttaagacctggatagacttttgtaaccatcaccacaaattgggatatggaacagccccatcaccccaaaaaactccccctgctctgcttccttcagggcaagccctccctccacccctagtccctggcagccacagacctgtctacagtcttgtagtttagccttttctagaaggtcatataaatggcatcaagcagtatataaagactagcttcaaagtggagaaaactttaggcctctaaggcattttaatgcccgcatagtcttcatctttagggtaattttgctctaaaaacgtttttgctgttttggtgaaatatgtaatactaggatagactatggaagatgtgcttactgagttcttaccctcaatgtcaaaaacccaacagactttcattactgcatcccctctgtacaggatcaaagtgcccacccttagaaagtctgatgagacagagaagaatgacttgcgaggatcaagaaagacaggctgagtgagcagtgtcctggcctgaagcctctgagcactgcggttgtccctcagcacccctggggagtggttaccagaacccccgtgggtaccaaactccacagaagctcaagcgccttaggtaaaatagtgtagtatttccctataacctacacacatccttccgtgtacttgaaatcatctctaggttacttgtagaatcaaatacaatgtaaatgctatgtaaaaagttgttctactgtattgcttaggaaataatgacaagaaaaaatctgcacatgttcagtacagatgcacccatccttttctttcttcccgaatctttttgatccttggtggttgaatttgtggatacagatctcacaatactcagggccgactgtaattctgaaggagggggctttggggcgggagcctacaggaagctggaggcagggcactggggacttgaaagtgaaaaagtcagtcatgagcatgggagaaaggagaggaaggcaggggaaggcactccagatgaaagaaccccctaagtgcaggcttgaggtgggatggcacagtgagggcaggagagggatgatagatggtccacctggagcacagtatatgcagtggaggggcaagcaggcaggccaaggtggggctgagtgtctggagttgaccctcgttgccaccgtcttggagggagctgaatggttccagagtagaggctgatgccacgtgaccaggtgaggtgtcttgttgagaccgggcacagtgattcatgcccataatctcagcactttaggaggctgaggcaggaggattatttgaccttaaaaaaaattgttctgttgaacttattgccttgagacagaggagctttcccaggatggccatttcctacctgccggcctcagctcccatcgcctgcccttatgcccactaaacgcgcttgtccaatctcatggttaaggagccacgggttatggttttggccccatagatgagggagaaatttgctggagggcctgtgggagtctttggctctcttgcaagaggaatacagagttggcctttctcttccccactgtccttgccttcatgaagctgtgctgcccaggctgtcacggtgggacacggagcccagcccctgatggcaccatccatgtgttgctctcgatccctgttctctagattagctaagccagaaaaattagcctgatttgtctaagcgtctgcccatcgggttttcccttacttgccactaaacgagtcctgagtggctttgctcgtgctgtttcctccacctggatctccttctctaccttgtccagctggtgatctcttccatccagaaatttaacttcagtctgagtgagcacctccccagataccccaggcatcaaacacaatcattgcttacagggctgtgtccctcatcaaggagctgtgagcccctcatgagcaggaactgctccttacttctctttgcacctggaaggtcataaatgatcagcaaatattcgttggataaatgaaagaacaaatgaattccatagaaacaagcaagggaaaaatgggaaatgatttcatcaattcttgctaagtcacaggctttcttccttcacaaaaggatgcgcaagagagttgaggatcttgagtctgacaagcagagaggtgcttcttgttgtatttatcaaagcttcgctattaatccctgcagggtcagtgaacgcatgtcagctctgcactcagtcctgctgcacttcggtggactctcaccagaggtcaaaggctatcagctcactccttttgtctgaccaatgccttgggtggctgctctcatcctgacttgagctaaattgggtgatctgcctggagacttagaaccttattcctccccccaaccattcccactgcctttgccttgatctggactcttctctcctcttgccaggaccaatgctgccgctttccacctgtccttccctcctgtgcatcccacacagcctgcagctaagcatggttctgagcaagacacagcttcatgcaaaatattgtacctctgcttgaagacccaatgtgaacattgcccattgatttttgtttctcgatccccaacttcccatgccccaaaatagcatcctgggaccatagaaatggaattgagctttctaaaatgattctgcccatctcccactttacagatgaagaaagtgaagtccaggaagttgacattgcctcattcaaaatcatgtgactcattagcagtaagtcaagcctgtagcccagcttgtcaccagggctgttttcttcattacatcaccatgtctcttcctcttcactgcctgcgtgactatgtctcggcagtcaatggatacagcacagcattgccagcttgccatgtacaagggggacctgtttcagatattccatggagaccctggctggaggattgcaggagagtcccaggaggcaggactgccaatggcaccaggcttcgcagccatgcacctgcagccctcaggcagcactgtccattgtcatacgagtgtggcaggtgtgaggcatcgcatctgctcaccccggggataatgcacagcagctacaggcagatttcgggccagagagcaaccgagtgagccttgcagcctctgctgccagcacaggcttgttccttcaacactggtggagagagacacgctgtcatcaggcccaagaaatactgccttccccatcctatccctggtcactgggtgcccgcagagtgtcccagaggagggagggagggaccctccactggttcaaatggcctgttctcagagatgcagcaatggaccctcgtgaatactgaactgataatcatgggaaggagactggctctcctggattccctcatgattcctctgagtgacaatgtgatgttggccgactgtgtcttcttcagaatatcatatacacttgaggtctccaggagcctccaattacattattttcctggctcatacagtgacaagtaattcttatcctggattcctcgttactgagacttttcttgccttttttgttagcttatgatttattctaggacttcctccaacaggttatacttaactgtctacctcagtctctggaagttttaaaaatgttcagctaaataaaagaagtagattctccctggaaaccaaatacctatgggcctcactgaattaataatttatttatttctaaaaaaaggttttattaattaagtcaaaatttcattgtaattttaaaataatcttgtggtctttctccatgtgtctgaagcttgtaatcactcttattgtcctgtgaattctgatatgcagttacctgctagcttagtgggtaaacattttctctattaatgagcaggaggcttattaaactgtgacagtttagactattctttcaaggccattgatcagtgaaaaaacagaatctggatgctaaaaactgtgcccatgtgaattaatttacccccatctttccctgagccatcacctgagtatttgttcctaggtttgttggctgcatttgcttaatttttatcttgtgatttcattgagaggtgtagttgagtgggtgtacttacagcttctgttcctgtttgaaatatcatttggaaacctgatcacaccctgcacaagtatgcttgtgaggcatactaattcaataccatttgagcaggtgcctcctaacgctgccctcctcaacctttctcagcatgaatgtacgctttttcatgtgctgattttaacataatctttggttcacagtaacagagaattttgtttgaaaaaattcagggattgaagggatattgacatgtacctagtcaccatctatcactccatctcaggagcaagtgttccttgctctcgtgactttgtcctggtgacacagaattcatccttgtagaccacttactttcttcccaggctgggcagttctggcttttgcaaagttcttcatcagctaatttaagtctgctttttaaaacttcccatctgctgaatctcattccaccttttatgcggcagtgtccactgcgctttctgcagtgacggaaatggtctacagttgcactggccaagatggtggcattacccacacgtggctcttgagcatggggaatgtggctggtctgacaaaggaactcaatttgtagttttctttaattgtaatcaacttaaaattacataggccatatgtagctagtggctaccctattgggcagtacagttctaaagcaatgctgaatatttaacgaccttcagatatttgcagacagctctcctatccacatctttagccttctttggcccagccgaacaagtgtttcagatcatgcctctggactcctttctgtctccggacttcgtaacagcatggtcacccttcattcacctcattagatatctgaagtaatgacggaagtaatcgattgagtaaattagtgaatgaatatgtgattttaattcttcacataaacctcatcctagctaatcctcttgtcttctttataagctgaggtttttggttttatgactgtggatgggaagaggggatgcagaggataggaccaagcaaggtcgtattttctttaataaccacatccccacctgtttcccagttgggaaaaacacaaaccgatttgctctcgggtaccactagtttattataataagatgtacaaagcaaggcagatgaccctgcagtgatagcagggatggtcacttgtttggcagaatggcccaggggagcatctctagccgtttcaatcccaagaaagcaccttggggtagagatgatgcaaaaccaacctgtacatcgaaatctattttttattattcaaaaattacaacctggtcttctgaaacttatttttttatgcttttacatctcctacagccttacacataatttctagtgtctttttagaacctctcagtattgtaacatttaatgcgttctcagcagcgggtaggtccgtgttatgtttgcatttgaagtagaagagctaagctaaaaaatatgcctttgtttactaataaggtagatactatttttttgttgctgttgtttgatatggagtttaactcttgttgcccaggctggagtgcaatggctcaatcgtggctcactgaaacctccacctcccaggttcaaacaattctcctgcctcagcctctcgagtagctgggattacaggcatgtgccaccacacccggctaattttgtatgtttagtagagacggggtttctccatgttggtcaggctggtctcgaactcccgacctcaggtgatccgctcaccttggcctcccaaagtgctgaaattacaggcatgagccaccacgcccagccgatactattttttactcaaaccaaaaaatatattctgcgagtaagtgatccactgtatctcagcccataatgatggcctcgacaaggaatgagatggccacagtcagtgtcacccactggaccacagtgatgggcgtggtgaaccaagaagtgtggacatggcactgtgctgggttacagtagtgagggaagcaagcttagactagggagcaaaatcaacctgtgatgagttgtgccttcctttaagcatcttggcatttgttgttggcattgaggttatagaccggtggtgcaaagacgaggccacaagggccactggagaagagggaggagagcccaatggctagaatctggaaggacagccacacgtttccccctctgattctttaattcacccacaacatatgcccatggtgagttcttcaattgcaggcttttggtacaggaaatgagctcttgctagagatttaagacggagtcaaatcatgggtctagccctaatgatgagtaactgatggtgaggatgagagttgtgacagtgctggtggtcatgaggaggatgaggatgatgaagaagaaaacagcagtaacaaggacgatgatgaaaacctgctaattatggtgctgatgccagggataattatggtagtgataatgatcatgatcccaggaggacttactgtcattatttctcagtggcttttctttgggtagagagtgagataattaaagtctggaaggagacaggaacagggggcgtgcagttcctcagatccatgggtcccgcccagctgcatgctgggagtgaaactatcaagattaagagctatgctgtttcagcagcatttccactgtctaaatataaacagcctcaggccctgatccagcagaggagaccacagctgccaaatgcatcgccagctgcaggccctggctgggtttctttaggggaaaaggccatcccaccatggacaggttccaaaaggcatgagcctgcgaatagaatttgaggttcaaggaatgctagactgtgcgtctgtgttcagggtcacagagcgagtctgaagggagcaggatgaggacatgggtgccctgcctccagggcctgtgctctctgctggtacagacaagggcctggtgagatggtagaacaggggcggctactgcagtggtgccacctgcgtaggaagacgggaatctagtggggatgggcaggggccaggctccctttgctttcgcaggcacccagctccagtggcccctcagtcccagctacagatggactttgagatctgatgacaggatctgctgttatcccacctctggatcaacggcgccatcatcggtgccccagctagccagcagatgtgggccagagtaaggcttgactggtccacatgtcctttctggcttaagacactgcttatcttgactcagggagagaaggaaatggaagaagaagaagaaagaagatgcatttaaaacatattaccaaactaatgccatgaacacatgaaatgtcagccttttgattccctcctgccaatacgcatccgtttatccagtgctgacttactcagccctgaacatgcaccaggcgctctcgcaggcacagggaatactgtggtggacagagccggggaagcccctgcgctcgtggatcttacatcctgctggaaagaccgtgcataaatagatgtgtttatcatgtgtcaggcaggacacgtgctccacaggaaagtgacgtaaggtaaaggacagggagcaaaggggagtgtctgggggaggacggcagggacggcagggacggcatggaagcagtggcccagcagacgcaggacaaggtcctgtgatccgaggaggggtctcagggtggagggacagggagcaggccagcgtggctacagtgcatgatgtccaggatgagcaaacggagtgatgtttgaacatgtcatccgggaaaactacacacaggggcaggctcacagccactttttccccagctgatcttgcttcctctgttaccaaaccaccctcaatacagcctcgcaaactgagcaacagaggagggggaacacaactaataccccatttggcaggctggctgaaggctgttgaagaaacagcagaaacacctggtaatccttgcaggcgtcacccaggctgcgggccggagctgtcatgggacaagcaggaggctggaatggagctgggatgggaaggaacacaggccatcagcttcccaggccccacgttaattgtgtaatatcatcacagcagggtaggatgccctgtgagggcacctaacaggtgttcatcacattcatcagcattgccctaccaacgaccgtatttacatcaggcataaatgcagtttaccgcactctgtgagaactggggattaatagctccggtccagctagattctgatttccttggtaggaggaggcagaacagcacacatcttgactgaataatcgtgcattttgcatggttaataattctgagagcaggaaagctaccttcctaggatcacagagagcttactttcttttctacgaatctttgaaaaaccaaacagatgggattttaccttaagagttagattgcactcttacactgtgctgttcaaattatgaattggcctcacttggatgttggactattgattatcaactctggcaagctctttattcagaatcttaggacatgcacattaaaagaaaaaatcctctctttgacctggttgccaccaatgtgtatctacataggatgaaaaaatgcatcacgtactcagaagaacgggctgcagccccggagccccagtccttctgccagctctggagcagggggagctcctggctgcacctgaggtgtcagtctccaagaacctgagccctttccacacgcatggctctgttctaggcactcgggggagctcaaacagaaagagagtaaacctgctgctgttcagtcagagacccaagtcatactcacaaatgatcaagctagtgaactggatggcattttcacagctagatcttgtactgcaattatagattgtcaccataaagcttttgagagcaatttaatagttaataacatcctaattctatgatgtgagtaatctgtgctctgagaacggcctacatataggcagaagaaccatgaggagctctcaaagaaaatgtgccatatattcaggcacctggggagtggttgtagaaagtgtgaccttccaaggcaattgattttggttgttctttaaaggatcactctagcagtccggtcattcttatgggtcctctggtctagatgcccctcatggaggatcttctaatcttgcattattagaaatggcagctaagtggattatggatggaaactttcatgttgtaaaaacacaccaccagaagtcaaccattcttattttgcccacgtattaatgctatttccaaaactgcccgacagctcacgggtgtaggggtttaggggtctatattccttgttagactcaagctccttgaaggtagggaatgtgtcttactcattactgtatcctcagtttcttgccccattgtgcaagctaaataaacaatgaatgaatcaatgaatcaatgatgaataaaaggaaattagttaaattccccttagatagcaataattgtccttctcaccccaggttatctacagccagataccatttggattattgaattcctaggatgttccttgcctctctgattgtttgccatctaatcatatccactcttatgtttttatttaacttcttagtatacatacctgattcccacctttaagtatcctaaaggaacacaatgccttatcttgctttccctccgcccttggcacacaccacctaccacaacgttgaacttacagtaaacgatcaaggacaagtttcggactaatgcatttggatggaatggcttctgtggctttcaaacagaattctagatctgacctagaccagacccagatcctgcctggatgtcaggacttccctgtctctagagaggcagcatgaacagagacacaatgccgggcggattgttctgacctggctcccagacccaggccaggggccagggtgtgtgtataagggcatttgtattctgatggcctttgtgggttttttaaaccccaattgtatcattgattttttttttggcattgacgttaagattttcattcaatggtgatggattttaaaattgccctgccatgtggggtgttactaaagctcatgtggatgaaggctgttgaacgcctgtgtctgtgctcacactggctgctttgctttcctttcctgcctgacacgtcctctccatcttccccttctccgttgccatcttcctgcccttgtctcctgccagcttcctccttttctgcactcagccttaccctttcttccccttatgcttcctttctgggactcccaaacccaactgtgctttagagaaagagtcctggactcaacgccagggaaatgcatgcccgtgttcctgccttgctgccttctactctgaccttgagaaggttatgaactcttgggcttccattttgccatctctcaagccagtgagttagaccatggatgaaagaccgcccatcctaggattataaactgggtaagatttgcatcaatgtgagtcttcacactgatgctggctccaggtttcctttctccactgtgagctgagttaaaaactctctattaggaggcatttcacataccattgtcgaggaggtgggaaataacaattccattcatttgccaagtagaaaagcccttgccttcttggttcattcagcagagggaaaagtaagctaggcggaggcaggaatggcctttatttgcaaaggaggctgtgcctcactgttcttcaacaggatgcctaatgagttagaatttgagtagcatggctgggtgcagtggctcacgcctgtaatcccagtactttaggaggctgaggcgggcagatcacaaggtcaggagtttgagaccagcctggccaacatggtgaaaccctgtttctactaaaaatacaaaaaaattagccaggcatggtggcaggcacctataatcccagctactcaggaggctgaggcaggagaatcgcttgaacccaggaggcagaggttacagtgagccaagatgtgccgctacactcctgcctgggtgacagagcgagacgccatctcaaaaaaagaaaggttatgcctcacaggttctgacattcagtaggatttgcactttggtgcatttttctttgtacataaaaccctcatctcacttttagaacagtgcagtacttaactttttccaggattaggtattcatttcagtcatgaaaaagaaaagggcatttgacccaaattacaaaaactattgaagtaaaactgccctattttttccttcatgctttcattgcaaaatgcagtgactgtctgctgctggatgagtgtgtatttgggggctctgagggatggagaaggagaggcacgactcgcaagtgccaggaattcacattccgctgacgcgggaacacgggcagtgtatagacattgtacagacattgtaaagacattagagcacaattttgagaaaacgtgaaaggatttccacaagtctttatgtcctctgtatattaaggtgttaagacaatggatagcaagagaaagatgggattttgtggcagaaacttccaaaaaaaaaagttgacatggagcaggtcctcaaagcaggaggcctcagagtactttgtagtttaagtaggagggaggactcgggtatctggagatgggaatggaattaccagaggagaggagcattgaagaaatggcgtcaacactgaagaatgtgctgctttataagaataatgagcccttaaatgccagtctgaatcttagcttgacaaatgaggcgaatctgaacacctttgggataataatagcgccttgctctatttgagataaaatccatttcttctgacttctgaaaggaattattgtattggtccatttgttttattttaggaaattttaaaatatgaggtagaaaagtataaagtattctccaagttattagctaataattggctgatgtcacccaggtggttatataataaactgtctcagtatcattaaattctagaagtccagaagaagaagtcaaggacttcttagtattttgaggcagagggaagaactacaaaaaaacctcagggcaggaaaattggacctgttgcaggccctgaaagctggtgtgatttgagtacagtgagagagagacacagagacagagagggagagaagacagagagagagagggtggggagacagagaaggagagaagacagaggggagacagagagagacagtgggggccagtaggggaatggaagcacaattgtgggttggtgtctcctggctcaatgcctaatgagttagaatttgagtagcatggctgggcaccgtggctcatgcctgtaatcccagcactttgggaggccgaggcaggcagatcacagggtcaggagatcgagaccatcctggctaacacagtgaaaccccgtctctactaaaaaaagaaaaaaatacaaaaagttagccaggcgtggtggcaggcacctgtagtcccagctactcaggaggctgaggcaggagaattgcttgaatccaggaggcagaggttgcagtgagccaagatcgtgccactgcactccagcccgggagacagagtgagactccataaaaaaaaaaaaattgagtagtatattactttgctagggctgtcgtaacaaagtgctacagactgggcgtcttcaacaatgaaaatgtattgtctcacggttctggaggccagaagtcagagatcgaggtgtctgcagggtgggctcctgctgaggctgtgagggagtgctggctccaggcctccttcctgcatctggtggttttctggcaatctttggtgttcccaggtgcaccaatgcatctccagcctctgccttcgtcttcacatggtgctctccttgtgtgcatgtctgtctctgtgtccacattttccctgtttacaccgacaccagtcatttggataaggatcttttttaatgacctcattttaacttgatcacccctgcaaaggctccacctcccaataaagtccctttctaagtcctgaggataacgactccaacatgtcttttctaggagacacaattcaacacatagaaaacagttaagaaaaaaaagagaaaatttggtaattgtcttctgtacagacttctattaaaacaatgaaatgtttatttaccaaaatcaggaccaagttacaggccagtattaatatatgaaactgcttgcgtttcacatgtacacttaaatttccagtcctgattttcataccaagaaacatggccaagtcatcacttcataaaggaaaaccgttttggaaggtaaaaaagacaattactgtttgaaacagtctaacattgaactttagatgtaaactatgccgagcaaacattttttccaggtaacgttatttgttgcagacagcctttggccattgtgtagatcccaaatgtggtgaaatgggagctcccagatcattgcccagtttccagctgccatcccgagtttgttggtgtcactgattccaagaacaaaacactggtgcatgaaattaacaaccttataaatagatgacagcacgtctgttagacaaaaggctgcagttatcccctagaaacaatcaaacacaattccagtaaaagtcttgccaaatacctctttgtaattcaaggaacctaacaacagacaatatgcagtgcctccttgtttatgttctggaactcagcgctgctgcagtgtaactgagaacaggctagtacaacccacaggcatcttgaagtgtgcaaggaggctcagagaggtttatagcattgttgttttgttttgtttttcatggttctttatgtcattgtttgttttataaagtgttatttatagtatgttcatccttagggacttttccttgaaaccaccacctttaatgctgatgattggtgttcccatggaccttgggttaagggggccaaatggtatagatgccctggggagagcttgctattggcctttgggagagaccctgcagcagtaggtttcagctctcccagtggcagagctgggtgataactgcactttcttctaagggcgatacattttgggaatgtgcgtggtgtgagttttctgccagcatctttatagagcaatgtgtacttgcaaataaatacaaccaaagtcaacaaaagagcatattgatgctttggtagagaactcagcagtctcccctctctgtagcgtaaaatccagggaaaacaaaggccccacaatggggacagatggccccgcataggtctaaggactgccattccgttttaaagttataaagtactctcacactgtttacctcttttatttcacaaaaccaccgcattaagtggacagggtagaagatattatcctcactttttatatggagaaaacgtggctcaggtgacgaggtgaatatttgtgggtaaggcaagaactttctttctttctcagtcagttctctctactcaagtggacttctttttattattattattattattattattatcattatactttaagttctagggtacatgtgcacaacgtgcaggtttgttacatatgtatacatgttacatatgtatacatgttggtgtgctgcacccattaactcgtcatttacattaggtatatctcctaatgctatccctcccccagccccccaccccatgacaggccctggtgtgtgatgttccccaccctgtgtccaagtgttctcattgttcaattcccacctatgactgagaacatgcagtgtttgattttctgttcttgcgatagtttgctcagaatgatggtttccagcttcatctatgtcccttctaagctgaccccactccttcctttcatggtaggcacacatgcaccgagtaaaatggctgaatctgggctccaaaatgttctcttcagtcccgcatgttttggcaaactttcctctctgctgtggcacttcaatcccgctcttctccataaggtctatccttttcttcataaaactttctcatggatggctccagtcccaaataaagctatcctcctgctcctggcttactccaatttcccagctcttttgggaaatgtaaactttatggtgtcattattccttttatgtaacttccttttttcttttctgagatggagtctcactctgttgaccaggctggagtacagtggcacaatctcagctcactgcaacctctgcctcctgggttcaagcgattctcctgactcagcctcctgagtagctgggattacaggcacttgccaccgtgcccggctaatttttcgtattttttgtagacatggggtttcaccatgttggccaggctggtctcgaactcctgacctcaggtgatccacctgccttggcctccgaaagagctgggattacaggcgtgagccaccatgcccggcccttttatgtaatctcttatcctgtcccaaagacaattttataaaataataataagtagcacttttgggtgattaataggtgccaggcaccatgtcaaaaactttctgtccagtatctcctttaatcttcacaagaaacctattgtggtaactcttacaccattttatagatgatgaaaccaaggctaaaggaaatatgatgaaatgtccagggtcactcggctgggaatttgggaagccaagttggaaactcagatctactaattttcaaagcttgcacttattttaaagtaatggcatatttggtttgttgtcatagtttaatcatgaactgtttcaagtgtacagaaaagtacagatggcattacttaaaaccacttgcagccaggcgcagtggctcatgcctgtaatcccagcactttgggaggctgaggcaggtggatcacctgaggtcaggagtttgagaccagcctgaccaacatggagaaaccccatctctactaaaaatacaaaatttgccaggcgtggtggtacatgcctgtaatcccagctacttgggaggctgaggcaggagaatcgcttgaaccctggaggcggaggttgcggtgagccattggactccagcctgggcaacaagagcgaaactccatctcaagaaacaaaaacaaaaacaaaaaaccactcacatccagaatgctcaaatttaacaagtgtgatctgtcttgttgaatgcgtccagggtcttgaaggtgtgtatgtatgctgatgcacttggatgacctgttgtaaagtatgtcaattaggtcaaattagttgatattttgttccagtcttctatttaattacttttgctgtgaattactgtgtaagaagtattgaaatctctcattgtatttggagatttgtctagttctcttttcaaatctgtcacgttttgcttagtaaatattgaagctctcacagtaagcacatatacatttaggattttcttgtcttatcattgaattgaccttttcatcattatgaaatgtccctggtagtattcctttgtctctgttaatattctgtgttcttcagtccatttgtttgataataaaccattgcagctttcttttgattcatatttgcctggtagaactttttctatccttttacttctaacctcttcatatgtttacatttaaagtatgtttcttataaataacatgtagttaggtcttgctttttttttctttcagtgagacaatctctatcttttaaaaagaatatttagagaacagattagcaaattatggcccctgagcctaatttatcttagtgcctatttttgtaaataaagatttattggaaaacatccatgagcatttgttaggtattgtccaaggctgtttttgtacttccaaagtagttgcaatacagaccgtatggcttgaaaaaccaaaagcatttattatatgtccctttatggaaaatatgtgctgactcctattttaaatgttacatttgatgtaattgtcagcatgatttaattgaaatctaccatttgctattaggttggtgcaaaagtaattgtggttcttgccagtaaaagtaatacttgtttctttatgcttctctcttctgatttttggttcaatttttcctgtcctcttttggctacttgagtttcttattattccaatttattttcactgttggattaacaagctctttgttttactttttaatggttgatctatgtttacaatgggcatttttaagttatcacagtttatctttgattgatggaccacttttggtatatcgtgtaaaagcctacagcagtattcttccatcatttcaccataccatcctttctgatattttgttgttcatttcatttctacatatgtttaaatcccataatacattgttattatttgtagtttagaaaatcaactgtctttaagaaaaaaaacagctttatatttatctatttcttaattcttgtttgtttttgttttgttttgagatggagtctcgttctgttgcccaggctagagtgcaatggcacgatcttgtctcactgcaacctctgcctcccaggttcaggtgagtctcccgcctcagcctcccatttctcgagtagctgggattataggcacccaccatcatgcctggctaattttttgtgtgtgtgtttttgtagagacagggtttcaccatgttgaccagactggtctcgaactcctgacctcaggtgatctgtctgcctcggcctcccaaagttttgggattagaggtgtgagccagcatgcctggcctatttcttaattcttaatcctttttttttttttttgagacagggtcttactctgtcacccagcctggagtgcagtggtgcgatctctattcactgcaacctctgcctcccatcttaattcttttttatagaaacgaatttcctctggctttattttctttctgtctgaagaatttatttaacattgtaatgctggtctactggcaatgaattctctcaacttttgtttatctgaagaattatttcgctttcattttttaaagtttttttgctacataaagaatttcaggtggacattatttttctttcagtacttaactatatcattccttgtcttctggctagcttagtttctgaggggaactctattaccattctcatctttttttcctttgtgtatatgtttcttttctctcttgactcattcaagattttatctttatctttgattttcagcagtttgaatacaatgtgcatagatgtcattctctttgtatgtaatttgtttagagtttgtgaactttgcacatctgtttttggtagtcttccattcagccatgatttcttcatgtgtttcttctgtcccatcctctcttgtttttccttcggggtctactcttacatggatattcggccattttaatcattccaggctggctgtgtgcggtggttcatgcctgtaatcccagcactttgggaggccgaagtgggcagatcacctgaggtcaggagttcgagaccagcctggccaatgtggtgaaaccccatctctactaaaaatacaacaaaaattagccgagctaataatcccagctactcgggaggctgaggcaggagaattgcttgaaaccaggaggtggaggttgcaatgagccaagattgtgccactggactccagcctgggtgacgagagtgaaactctgtctcaaaaaaaaaaaaaaaaaaaaaaaaaaattatttcaggctctggactctctgttcttcttttatttacttatttactttttcttcttttctcataaatataatgttaagaagtagaagtcagacataaaagaataaaactatgatggttccatatctgcaaagtcaaaaaatgcccaactaatctatgaaaataaaagtcaggttcggatgtagggttagaatgtaatgattgataggtgcacgtgggatttcttagtgtctgataaagttctgtttcttgatttgcatggttgttagaccaggtgggttcactgcaaaacttcatggaactgtacacatgatttgtgtactttttctggacatgttattcttttacttaaaagtttattttaaaaatcaaaaatagctttccgtgtgtttttcttctaaaagtcatacattttgtttgggtccataatcttttcagaatgtatttttatttatactctggagaaggtaagtttatttttctcctacaataatagtcaactcttcatcatgaatgttgcatcatttcctggtagtttttatcataatcttggccatgtatgcacgatccttttctcgtctttctcttctgttctatttatctatccttacacaataccacacattagacattctatagctttatgacaaatctttgcacctgatatggtcagtcccttctaattctcttctttaaaaattgccttggctattatttgccttttactcttacatgtaaatcaggaaacagcttttaaattttattaaaaatcctattgaaatgatattgaattgagatactaagttggagagaattgactactttatgatgttgaattatcccatcctggaatatgctagataatataagcacaaagacttcttttaagtcttctaataaaatgttataatattcatcatagatgtcttaaatataatttagaataattacttctgcataattttaaaatagggtaaattagtgcttctttttaatcacacactttgcattgagtgttaccagtgaaaggaaatgctaaagactcattagtaggaatcttgtatatagtgaagttaccattttcttgctaagttcaaatggttggattctcttggatagtctatatggacatttgtaaacaatgacggttttgtttctccccgtccttgcctatctcttttgtttgtttgttttgtgtcttcctacactggctactcttttccatccaatgttagcccagaaaccatgacagcatgcactttagtcttcctcttaatttaaaatgaatatttccatattttcatgcctaagtgtgttttctgtatgctttggtatctcttttttttttttgagaagattaatatagatctcttctatcccttgttttaattttcatattttgaattataaatatgcactgtgttttcaaagaatttatttttctttgcatatagaggtgatcgtattgttcctttttgtttaatctactactataatgatttacctaaatgaaatgtccaatattaaaccaaccttgattatattcctaaaatacaccttatttaaatatgttattcttttttaaatatacattgacagatgtactttgagggtcctcatctttatttgtacatttttagtcagttttacgagcaagagggtatctgttccatctgagcttgatcctctgatgattcattaattccttttaaactactgtttcacttcctttaatggttatacttctattcaggtatatttcttcctgagtcaattctaagatttgtttagaaaattaccaattacatttaaatgttcaaaattatttaataaagttttgtatattttcatattatatttttctactaattacattttcattttctgtccttatagtgtttgtcccttttctgttttgatcttgatcaatttttatataattttgcatgttagtactattctcaaagacctatagtttggttttcattttctctttttatctttgcttaatctctcattagtacctactcttattgattgattccttctttctgctatctttgcatttaatctatttttaaatttttaagataaaatatggcacatttattttcagttttctatcctttctatgaaataatgggtacaaatttttctctattattttagctggatctgtgagtcttgatacggagtgttcattacattcaatgctaaatatttcatattttgcattataattttttactcatgtgttattttgtttccgaatatatgctttatttacccttttcacaaaaagttgttgattataataaattaggaattttcttaatttattacaatacaatcaagagtttactcagtttgagatgaaatttctgtatatttgagactttgtatttgatcaattttcatgacaaggattaatttataaccattgaaagaggacccttcaattggccactggcttattagttatattgttgcaatattctctatccttactagatgttagtctctatgacctatcagtttttgagagcaatgtattaaacatcttataattctatacacttttgccttatgtattatgaggccatgttgctaaatgcctacaagttcaggattgtaatcacttcctgatcaattatttctttttatcattaactctccgtattcctagcaatgaaatttgtgtgtctttttgtttccatttctattttctcaaagttatatttgtctgctgggagtataattgcactagtttttgttttccttttggttatttgcctggaatgtgtttacctaacccttactttacacctttcttggcccttatgatttaattatgtccttcctgaattgcatatgtttttaaacatctaacttaaaggaatttaacctgcctataattagtatgattacagttgaataacaggtttgaactgtgcaagtccactgataagtgaattttttacaatattttagaataatttttggacacttatgacaatttgagaaaactcacagatgaactgagtagcctagaaatatcaaaacaattaagaaaagttagatggtcataaatgcataatatgtagatactagtcttttttgttattttcttctataaaatatacacaaattataaaaagttaaaattgatcaaaacttttatacacacacatacttatagactgtacatggcagcattcacagtccagaaaaatgtacataaatgtaaagatacagcattcaaccacaactgcgtaagattaactgtggtgcatactgtactgttgtaataattttgtagccacctgctgctgctattatggtgagctaagtgtggtagattgcaagtagctgcatgaaatgccacgcgatgccaatcatctccacatgagcagctcatttctccagtaaactgtggatcacaggaaaaagtgatctctcacgtatttttcctcatgggtagtgcaatacagtaaaccttaaataaaactatgggacacatatgaagtgccactagtaatgctgggagtgttcccatgaagcagagaaagttaggacattgcaagaaaaagttgagccgggcgcggtggctcacacctataatcccagcactttgggaggccgaggcaggcggatcacgaggttaggagattgagaccatcctggctaacacgctgaaaccccccgtctctactaaaaatacaaaaaattagctgggcatggcggcgggcgcctgtagtcgcagctactcaggaggctgaggcaggagaatggcgtgaacccaggaggccagagcttgcagtgagccgagatcgcgccactgcactccagcctgggcgacagagcaagactctgtctcaaaaaaaaaaaaaaaaaaaaaaaaaaaggaaagaaaaagttgaattgcttgatgggtactatagagtgaatggttacccaccatgttagacagacgattcatcttgtaaacagaaaacatgaacttattatagtcctgtaaatgtattttcttttccttatgatgtttataacattttcttttctctagcttgctttattgcaagaatacagcatataatacctataatgtgctaaatatgtgttaattgactatgttattagtaaagctattagtagttaagttttggaggagccaaaatcatacatgtatttttaactacacgggaagttggcatctctaatctttgtgttgttcaagggtcaactgtactggtaaacttgaactattcctaaaataatatttagttttttcttttttttttctttttttttttgagacagagtctcgctctgtcacccaggctggagtgcagtggcacgatctcagctcactgcaagctccgcctcccaggttcaagcaattctcctgcctcagcctcccaagtagctgggattacaggcatgtgccaccacacctggctaattttttgtatttttaatagagatggggtttccctgtgttagccaggatggtcttgatctcctgacctcgtgatccgccccctcggcctcccaaagtgccaggattacaggcgtgagccactgtgccccacctagttttttctaaataccatgcttgcattttttaggagtgatcatatatatatatatatatatattttgagatggaatctcgctctgttacccaggctggagtgcagtggcgcaatctcagctcactgcaacctctgcctcccaggttcaaaggattctcctgcctcagcctcttgagtagctgggactacaggagcgtgccactacacctggctaattttttttttttttgtatttttagtagaggtgaggtttcaccatgttggccaggctggtcttgaactcctgacctcaagtgatccgcctgccttggcctcccaaagtgccaggattacaggctgagccactgcgcccggccgatcatatgttctttgttgctgttttcctttccagtcatccctgtactcatttcatgttattgctcttgggtcttttgattccatcattttaaccttctgtcaattagtcataataatcattactgatttatacagcttaatttatacatattcaataattgattgctaatcgttgacaactacccctcccttctgaatttggtcacctttaggagtcatctccgtgaatatctgtgactgataaactgcttcagttcaggtagatggaattttctagttccagtcccgttttcaagaaagtttaatctatgtatgggtactggctttattaagggtcaacagttttagatcctaaccccaggagggcccaaggcactcaccctgtttctgtaaggtcatcacaacctcagaccctaggcctgtattcagacctgctgccccactagctgcccagactttcgccaaaactcaaatgttctcatcgtgaatttatcttcacttctggcatctagatatttcccttatttcgcactttacgtattctcgaacagtttcgttatgttgtatccatgtgtacgtaataggagggtattctctgttaacttaaaacagcatgttgcaggaacccagtactatctttctttgcattgcccatgcaagtgagccctgcaatataaccatcttgtctgctgagactttcttacacattttcagagtattttctaaagaagtcatcacatctaagatgcaagcttacaagcgagttcactaggggatttactctgtagacatgttgattttgatctaaatttaatgcccttgtttctacaactgtatttgtttactcttttgtgcctgtggtataatacactatcttatactctcaagcatttcaatacctcttccagtgtttctagatcactctgtctctctcattcacacacacatgcacatgcacacacatatacttttacacatgcatgcacacacatacatgagcacacacacatttacatacatgctcacacacagcacacagtgggacagtctgttcacaaacactacagaacaaacttccttgtctgtaggaagatatgtgtgcacctggcctctttgctgttcttacgacttgcccttcccaagttatttctactttacctctgtggttcgtttgatagaatttccagttaatgtattataagttataatatgccttttctggaataaatctttgctttcaatagatccattcactcctttccagaaatgatcgctgctttttatattctccttggaaaaacaaaagcacctgccttgacccttgtcttcaatatcacatataaccatacaaaactaaaaacaatccattcatttattcctttggttaatagatttttgttgggcagctatcatgttgtatgcggtgtgttagatgctgggtatgttctatgaaacaaaatagtctctgacccctggaagagaaagaaagaaagaatatccctcgccttacctttcttgacccatagtccaactgaagagagaagacgtctgttaattaactaacaatattaagtagcaaattctgagtaccaaatgagtggtattgagatcagctgcctatttgtgggctgatatggttccaaatggcttcacttgacagccttgaaattgagtcttgaaaagggtgcagaaatctaggtaaaaaatatcgatggggaggcatttcaggtgggagaaggaaatgaagaaagaccctgaggtgttacatggggtcaaaagaaaggatgattcaaagcaaggagagagcagagaagagttgggctgaaaattgaatttcctaccacttgtaggtaccaagttgtgacaatgagcttgtcatttcttgcagcacctgtcttatgtagctaaaagtctctttgagttctgcaatggcatattgcttctacggccaacattctgtctttgatagtgaggtcttacattagcattaaatcaaatgttatattgaaccttgagtaaaatctcttccaatttatgttttttttttattatttgtgtctgtgttgttctctgtgtgtgtgtgtgtgtgtgtgtgtgtgtgtgtgtgtgattgtgcacctgtatttgcgtttctcatctggaaaattctcttattcttttcccagggtttgcactgattttcacccttattcactcatctgaaatatcctttttcagtttaatcccagcattttatgtggtgctagactttggcttattggattgtaatttccaacttctaacctctcacctttgtaagacattgacactgaatcatctttcctcactctcagtataaatggtattttaactccaagctggctgcctgttaaattcatttactgtgctagagtgtatctggtaacttgcctgtgatgaatttgtgtccattattacattatagatggtttcatgcagccatctctgcaaagggcctaattatagctgtgatggccaaaactacttgttacctcgtgtcttctgactcatgtgacttgtacatgttttgacaatgaacagttctaccctccaccatggttagataaggtggaatctttttgataggagacctatattagttcagataaatgatgttgcttgttacgtacgaacacacatcactttatctcgttagcttgggaaatggatacgggcagagtgtattattcattttatatctagtgctgagagaggggcacttcacacaaaatagtggttcagcaaatgtttgtgggatgccaaaaaagcccccacaacaaaaagtggacctctttggttatccaagagagatgttttgtcttttggttctagaaattttttcttgcttcctcatctctcatagacatcctagaggagtgtgtgcatgtgtgtgtgtgtaatattaagcaaccagccattctttaccaatagaagatatccttgtttctaacaatgagacttcttctaatagtgctaacactttatctcatgtatgttatttattttttgaagatatagctttgcattttggaataattggagactcacatgcaattttaagaaataatacacaaagatcccatgtactctttgcccagcttcccctaaagttaacatcttgcacaactatagtacaatatcaaaaccaagatgttgacatcaactaatcttatttagatttctccattttgctttcatatatgtgtgtgtgtgtgtgtgtgtgtggtgtatgggtgtatttagttctgtgcaatcttattatatgtgtaggtttgtgtaatagcacctgctgtggtttgaatgtgttcttacaaaaacatgtgttggaaatttaatctccactgcaatagtgctgggaggtacagcccaatgaaaggtgtttaggccatggattgatactgattacaaaaacagcttgagtctgtgagcttgctgtcttgcccttctgccttcctccagagacccttgacagatgtgggccccttgatcttaagctttccagcctccagacctgcgagccaatagatctctgttcattacaaattactgagactgtgatatcctgttttagcagcacaaaaaggactaagacaccaccatagtcaagatacagagcagttctgtcatgaggacccctcgtgatactctgacagccacagccactccttccctccctaacccctgacaaccatcaatctattgaccgtctctaataatgtcatttcaagaatgttatataaacagatttataaaatatgtaaccttgtaagattggctttttctgtttagcataactcctgagatccacccaagctgttcatgtatccatagcgggttcctttttattgcggagtaatattccatggtattggtgtaacagtttaaccattcactcatttatggatatctgggtttattccagttttgggctattacaaaggaagcttctataaacattcaagtatggtatgtgagtgtaagttttcatttctctgggattcttgtctatgaattcaactgctgggttgcgtggtgattggaagtttagtttattaaagaaacagtcactgtttcccagaaagactatgccattttccattcccaccagcaatatgtgactcagtttccctctgtcctcatcaacatgtggtgttttcattatcttgtattttaggcattctaataggacttgtcttattgggcttattgtcttatttgggctactgtaacaaattaccatagactgagtagcttcacagaagtttatttttcacagttcaggggaaagtttaagatctgggtgctggcatggtccatttctggtgaggtccaccttctaggctgcaaacttctgacttcttgttgtagcctcatgtggtgaagagcagagaggagaaacaagctctctcgttactataatgagggcactaatctcattcatgagagctctgcccttatgacttaatctaatcctcattacctcctgaagtccacagctccttatccatcagggggtaaggtttcaacatatgaattctggggtacacagacattctgttcataacaggtatgtaatgacatttactttctaaatggtatttgaatgttgttttgtttattgaataaccataaaccaaggagttaagggttgcagatgctgtaaaccttatttaacagatgaagcaggctgggtgctgtggctcacgtataatcccagcattttgggtggctgaggcaggcagatcacctgaggtcgggagtttgaaaccagcctgaccaacatggtgaaaccccgtctctactgaaaatacaaaattagccaggcatggtggtgcatgcctgtaatcccagctactcgggaggctgaggcaggagaatcgcttgaacccaggaggcagaggttgtggtcagcagagatcgtgcaattgcactccagcctgggcaacaagagcgagactctgtctcaaaaaaaaaaaaaaaaaaaaaaaaaaaaaaaaaagtagatgaagcaagttgctcaaatcagacacttgtttgagtcacaaaataatcaatggtagagctttgtctgcaaccctacattactccctcattgttttatgttgtcctgattaaattgagcttctaactgataataaaatctattattcccaaaattgggccacccattccccaaacgtcctaccttcattctagaatgtcaaacacaagccacagctgagcagcaggacctccatcagcatgcaaccacatggccagccacgccctgcgccaagcctccagatggagaggatttggtgggaaatcatttctgctgctttccgcattccgcatacagtgtcttcttttaacatggcctcttgagagccactctccagcggcagcacggccagcctctgtgcctccactctccaccccaccttgcccatccacagctgtcttccctttctcttctctctttgcagctattctcccttcccaatccagcacagcagtgtggctctccttcctgtacactggtctcctattttcccttctctcatcacataaatcaggctcacatagggttagcttgcgttagcttcttttaactggttgttctgttggttttaattttcctatttttgggattggtttaattatgggaggagttagaggctattttaatgaaataattatggaattagcctaggttttttgaaagaaagaggaaggaaaggtgtgttccattctgtttgcattttttcttctgtatcaagctttgatgtagctttttttccaggcagaatttaggtgcaaatggaaaggtctcaatctgactcaagtcagagtactgtgtgtggttgttctcaatggtttattaggttttatagctctgttttcttttcttgacaaagttatctcacctttgcttgaaaaccatgtttctctgaactatttggtggtttcatgattgcttgtgcttaaattaatgtcagcagcaaggcaatcagtagaaacttcaagtttaaattctcctgaaagctaactttaaatgttaatgtttcatttaattgaagcattctgagatattagcattaaccatttagagcacttttattagataaacggaagaagggagaaggcctaattattgtaagtcatttctgttagacatttatagagaacttgcctttgatgagaaaattgcaaaagaggccaagtatgtcaaatgttgttgtcttccaattcccatttcaatgtgcaaactaatcattcacttccctcatgggaccgctgtgagtttaactgggcaaatacatgtggagtccatgggtgaatctttcattcagtgcaggctacgttgggcgctgtggtcagctggaggcccctatttgacaagagacggtcagaacttagtgtgtgttttctggggctgttttgattttcctgtacaggagagttttgcagggaggcatattgggctggaaatcaaaaggccgtggttcttgcccatctttatcatgggtagatttctggagccagaaccagagccaaataacttcctgacctgcaaaatgaggaggcctggaagattatcctaacgagcctctttgctctgtagttccagcaattatatgtattctgtgaaaagccaataacgtgcaattcctgatagtgaaataactctggagcccatgaactcatgcttcataggccagccctacagattaggaaatgggtttcttcctagggtttttattcaccgtacaatactttcacattttctttccaaatgactattaatcacatattgaattttaaaatattataatccattttccctccagtttttgtggaaaaaaatgtatacacataacgtttattattttaaccatccgtaagtaagtatacgattcagtggcattaaacacattcacaacgttgtataaccatcaccactatctatacacaaaactttttcatcacccgcaacagatcccaatgccttttcaacattaaatactgacttccccttcccactgttaccattcacaatgttgtgtaaccatcaccactatctatacacaaaactttttcatcatccacaacagaaactctgtccccgttaaatactaactcccctttcctactcttaccattcacaatgttgtgtaaccatcaccactatctatacacaaaactttttcatcatccacaacagaaaccctgtcctcattaaacactgactcccgcttcccactcttcccagccctggtaagtctccctctgcctgaattccccaggagtttgcctattccaggtacctcgtacagtgtctatctttctgcatctggtgtattgctcttagcataattactccccctccagttttaggagaagcttcttcccaaggagatttttgataagaacaggaggcggccagctcagcttcctgggatgatttgggtacagccccacccagatgtctctaatttggcgttatcagagtcagtcaccccactgaaaagcccgcctacccatgagcttgggaagccctacatttacaggatggtcagctgtccccatgcccaggagtggttctgtctggagctgattcacagctccatcccctagaaactgtaattcaacaggtcttgggtaagatttagggatctgcattctaaagacagattccattgatcccagtgccttttcaacagtgaacactgtcttctgcaaacagctcacaattgtccatgaaattttgagcttaaggaagttctaacgcccccctcccctcctttatttttgagttgaaagagggtagaatcaaaaacaatactgagaggggtctaaaaatgcaaacacagagagttgctggtttaggagggctgggaggctatgggagaccataggcatagagaaaacattccttctctgtgactctcgggcgcgagcgaatccccaagggggtcaccagagaatcatttcctctttgggaatacaacatgagatggttctttcatctggacctaggttcaattaagtaaatagagcaaatacaaataagagaagaaaagcagcacaaacagtgaaactaggtctttacatacctaaggaggagccgtgagcattcgcctccagggaaccacagtgacgggaaacatgctggaatgttaaacgttccatctcatttgtaggaagcagatgcctacatcttcaaattttgtcttcttaaaaatattattttatccagataaaaatctataacctctagcaaagaaaaaacaacagctgcaagttggagatcatgaactgtctttccaaagaatctccacgtgtagctgatgtcagatgccatcagcagtcagccttcatcaccccaacgccaagtatttgttcagtttctgctccatatgaatgcatcttggatagaatgtgtttggtttggcttttaagaaggctcactgacttagcccatgacctaaagcatatacttaccaagccttggaattcctacagagggccctgcactttgtgtttggtacagagaccaaaaatacaaacccagctttgaggacagaagggcagggaagcaggctctttatgctgtgagtctctcactccaccccatggtccactctggaagcagaagaagtttctttggggatataaaatgtattgttggcaattgtttttgtgtgcagttaaggatcctggaattacagcatctaatgttctaactctactgccatatccatcttaggaatagaaatgcaattgcaaatggcaatttgaggtaagcaatccgattgtgcgaataggtcatatcagatggccaggaatcaagggtcatctaatgagactcactgaccacaactgaaatcagccaccagactctattttctctctgacaattgtgatatggagcaaagaacttcacctcccaccaccatccctgcccgttggtgactgctcgtgaacatttggttgatggatggacaaatgtatgtgtgaacaaataaattaataaatatgtaagagtattggttactggagtatgtattactagagaaataagcaaagacctgctccatacccttcccccaagaaaatagcaaatcattctcagttggaagactaaagagaaatgctagagtccaggccaatggaaaacaagttaaagacagaaggtttagtagcactggaaaacccaggaggacaaagattctccaggtcatcgggaggcgtcgtgctttttttcatgggaaagaaaacttgacccagagtggcttcattaaagaagggagagggacttcataagtgaccagtcgagagctaggccataggggctgcagacccgggactcaaacgatgtgcaaaggcctcagtttctctcttggtctctcccacaatgctgtctgctcacacaggctttccccctttgcactgttgctggttgcattctcgctctttcccccataaggctattaaagttgctgctggaaggttccagagctgtatgatcccggaattgtaccctgtgaaaaagcatagctgcttttctcacagagtaaagaggtccagccctgagttattttgcccctaatgggtttccagggtcgtgtcctttcccaacccctgaggaagctcagcagagatgcttcaggatgagattaggctcactgagcgggtgaacggagctgtttgaactgaggtctcagggagaccagccctctaactgcagcgagctggatttcagacccttcctgtgcacacacactgttgcttgcccagacatgcttcccctttgtcttgttagaccattgatttcctttagaagatcaaaatcagggtgcaggtaggagccttagacaatttctagtttgactctcatcatatttttaatatagccctgcattttcctcatatgaaagcagaaacccacagagtttatgatgtgctcagagccacgcacaggatcgctagaagccggggccacagcccagcttccaccctcctgatggggaccatatccatgtgctgctcttacatgtactgaaaactcagcacatgcctactaaatgctctgtaggctttatctcattttaacttcacttactcatgtaatctcagcactattatcatctgcatgtcacagaggagggagctgagatgcagagtatgtttgtgacttgcccagagttacacactgatatggtttagctgtgtccccacccaaatctcatcttgaattgtagctcccattatccctacatgttgtaggagggacctggtaggaggtaactgaatcatgggggcaggtttttcccatgctgttctcgtgagagtaaatgagtcttacaagatctgatggttttataaagggcagttcccctccacacattctcctgcctgctgccatgtaagatgtgactttgctcctcatttgccttcagccatgatgatgaggcctccccagccatgtggaactgtgactccattaaacctcctttccttgtaaattacccggtctcaggtatatctttattagcagggtgagaacagactaatacgcacataccatcgattggcacagcataggcactccatgttcatgactccaaagggtaccatctaccacctgttaactgcctactagtatcttcaaatcaacgtaagcctcgtagcgttacctattgctgccttgtcctaagcaatcatgttaatggtatctaggttggatgagctacttatatcttttcaattatacaggaaaaacaatggaaaattgtgataatgaaaagaatgtttgctcacaaaccactgaagatggcttcacctgccaccagtgatatgtgaacacacttatgaaactctcacctatattacacagccagggaggctagtgtatttgtggctgatgagggatcaataagcttatagcataacaatacaggtaaaaatttgtgaaagagccctggtcaccttcagggatggaattgacagcagaaagcccacagcaccaaggttaagtactttgttttgtgtgtatttatgtgcagaaacatagatgtgtatatgtgtagatatacaaccacattatacgttatacttagaagtgcgggttgcatacgccactgcacattagaatcactatacagaatccagcaaatcagattctctgatggtggggcctcaacatcagtacttttttaaaaagtcccaggtgatgtctaagtggagccaggtttgcaaaccaggtacctaggatagaggttttcaactcttggtgtgctcacagagaagcacttgaagtatctgcacagctttgtcaaaatgcagattcaaagcctcaaagattctgatgcaggtaatctggggtggcccaggaatccgcacatttcacaagcacgttgaatgattctgatgcaagtgaagggtctgaggaccacgccttgaaagctctgcacagaccccagctcctctagaggacttgcattgccatctggtgaggactgaagacccacattagctaattacatcagtatttttaactctgggaaaatgtaaaaagaatttagcacccagtgtaaatatggaaagattctttcttaaatgttcagtagaggaccctgagcatatggtgactatatagtcagtagcgactgatcactttttaatgtcagtttcatcgtaatcatacggcttccgaatgccacacattaaaatgttaggtccttttcttcccaacccaggattaaaattcatctcaaaggcaaaacatactgtgatttctcaaatgtttttggaactgtcaaaaccagaggatatatttagaggcctttaatgtagaacacaaaatttcactacacgcagaattgccaattaggatgggaggctcagaaatgatcttaatgacacaagtgtgcagtgtttttttccttctgcattacatgaataatttcaagggtgttttcactctgaatgagttttttttcctccatttggcactgcctgtggagtcctctctatagcagaggtgatgttacgagctgtaacgacgtccccgtcagcaagtagcacatgcttttccattagttatacttccataccttcgtttgcagttttgtttttacatacaggattgaaacaaataccagatagtacttttccaaattgttttggtggactcctccccatccacagcggcagacaactcacattaaatatgaagctttcaccacatacaatcagaggcctatcaaaatagcttcaaacttcaaattaatgccattttaggatcactgatgcttttctttagaatgccatacacttgaaatcttctaagactacaagaactgtatggacatttatagctgaaaagaaaacctatttttagaactcagagctgaaaccctacctcaatactacccctatgttttcaagagttcctgtttcccaatgctagtcaactctgaacctgaattttaaaaattatttcctctctgtttcctccctatctgagaagtcatttatttgatggttttagcttctactggcaactacgacatgatttggaagcctgctaagaatgagtctataatatgtttatgtcatgtattaaaaatctccacggtcttataacttaatataaccctatgtgtaattagttgaccgagagtccttttcaacattgattttgatatatgatttctaatttatttgtttatttacttatttatttttgagacagaatctcactctgtcgcccaggctagagggcagtggtgcaatctcagctcactgcaacctccgcctcctgggttcaagcgattctcctgcctcagcctcccaagtagctgggattacaggctcatgccaccacacccagctaatttttgtatttttagtagagacggtttcgccatgttggccaggctggtcttgaacccctgacctcaggtgatccgcccaccttggcctcccaaagtgctaagattagaggcatgagctaccgcaccaggcctctaatttttaaggttttaattctaggccgtaattttttctcttccaacatgataaaaagggtcttcccatgcccttctcttggtttctcttccctcctcatgcctaccgtttatctgtttccatgacctccctgcccacctcaagtcaggtggcacttcaacctgctggcaaacagtgccacccaacactggcacatgagtccatagaatgtctgggaaaagaggcttgtcgtaccatgtgatgtaaagtactaactgtgcaaacgtgcggcactcaacaattttaggagctttgtgattccttcttaatgatgtgcttaatatatttcccccaatgattgcttattttctctggttttaccctcctttatcaggtccttattgaatttcttcttttcctagttaaactggaaaagtaacttattactctgccaggcagtaggatcactcaccaagagacggtaatgagggagaccacatagcccagttggtctggtgatgcctgttttcccaacatagttattaatagcaccactttcactttgccactttggatggcaaatgatatagcgacaatggcactacatttgctactggcagctcaagaagatgttacagaggctggttttgacggaatcacatatgccagatatgtggcatatgtggaaatagatgggaattatgctggaaataggtggaggcccaattgaccctgcttgctcctgtttacctgtagcctctgcttttctgcttcagcctggaattgtcacagaatatcccagacctcctagtctgtacagggtctggttggacaagacccactggctttttagaattactccggaagtcctggcttgctgatcagaagacttgattcttccagaaagaggtagccaaggagacagaaaacaagctggaatcagagcaagaaagactatgtctaccaaacatccccgtctcttcctactctaactgtagatacacgtggataccatagcagcatgaatgagaccaacaccatcgaatgaccattaaatgaatggtcattcgtttatggggaagcagtactgcagggattatgaggtcttatggtttaaagtacagcacacatggaccacggtcccagccagggcagcctgctgtgggaatctctctcagcagatttttgcctgttagattccagaaccttctctggtcactttcatccaatctaattgtctgtcttacccaagaagggatttgttacaagggacttggtggattaagctaaagcaatcttaaatgcagaatgccaggtttctgatacagataatcaatttcagttgctgcagaaaactctgttgggggtgatggagagaatgcactttgtggacccgtctggattgtctcctagtcttgtatccaggtggcactgagcctcatcagtggggtccactctgttatttcctggcctttacttggtgagataaacccttcatgttcagcagccttgtaacagtttgcagaaaagtctccagcctttgcttatgtgttgggtgcaagtctactgatacatcctgagggtgtatgctgttgccggtgcgttgcactaaatgcctgctactgaaaatatgcccagggaatatttctctttatatctgtggaactttgtccatcgctgtgctggaaacaaactattccctgggcagtcagtggtgcgcttttaattctggcctgtgtggtggcagtgggaggggcggtgccttttgctgcgtcgggaacctcttgatcccaccagggtgagctgaaagaccttgaatatgatacttcaaataataaaaatgtatgtgtcaccttggatctgcccagaaaaggggagaggattttacaaacacacacacacgcacacacgcaacacgcacacacacacgcacgcacacgcgcacacacacgctgacacacacgcacgtacacgcgcacacatgcgtgcacacacgcgcacacacgcgcacacacacgcacacacacacgcacatgcacacacagagtcattcaggaaaaacaacaacagaaaacaatttagcacatttttggtgctctgaaaatataaattgggattttatctaccaatattaccatttatcaagttataactatgtatagcatttaattgatataaatacacacagcataaacttaccccaaagtatttatgctttaaaaatttatttacaaataatctgggagaaaaaggtttatttcaaaactatatagagggctgggcatggtataatcccagcactttcggaggccaaggcaggtggatcacttgaggtgaggaattcgagaccagcctggccgacatggtgaaaccccatctctactaaaaatacaaaaattaggccgggtgtagtggctcacgccagtaatcccagcatttggagaggccaaggcgggtggatcatgagatcaggagttcaagaccagcctggccaaaatggtgaaaccctgtctctactaaaaatacaaaaatcagccagacgtggtggcgggtgcctataaatccagctacttgggaggctgaggcagagaattgcttgaacccgggaggcagaggttgcagtgagccaagatcacgtcactgcactccagccagggcgacagagtgagactccatcttaaaaaaaaaaaaaaaatcagcttggtgtggtggtaggtgcctataatcccagctactcagaaggctgaggcaggaaaatcacttgtacccaggagacagagattgcgccgctgccttccaacctgggcaacaagagtgaaactctgtctcaacaaacaaacaaacaaacaaaaaatatatgcagagaagagagtacttaggagcacagtgggagggtgagatgtcagggctcagcatctgcttccgaagttgtcaccaggcatttgttcagggcatgtgggcactaagaggatgaccccgtggtggtcaggtaccttgctgctctgcacacaaacaatagaaagcaatggagcccttgttagaaacacatatttctaagctccaagcctggagcctaggaaacagtgtctcccaggaagaaacctgttaatctgcaccatgtcagggaccccaccccaggattcttaccagtagtgatgggtgagaaacactggctatgctaacagaagcaggcacacagcggccccgtcttcctcccatctgtgagcatgcttcagggctgagcatatgaccaacattttacatttcagagttggctcccaccttaacacacacaacaatgtggacaccaccataaactgtgacatcaccatcacccggacaccagtgggatttatgttgtgtggattaatggccagtggataaatatacagcaataccaaggggcaggtcaacagcttaaagattaggagaaaacaatgagtcagaaactgagcaggtaatcatcagagcatccgtgaataatctgacagactcctcagtcttccacatgtgcacgtggggcagaatgttgacatccaagtgggcatggtaagcagctgatgaaaagttaaggatggaaactttaggcttgaaagtcagcaaagtgaagctgacttgccaagaataaactaagcagctatgtggcatcatgcagatacacacacagacacttttttttttttaagatagaaggagaaacagcaggagagggaagaagtggaaagaaagatgctgacttgactggactcttcactgctaacctttggtgaaggataagtttagacacaggctgcctacatgcaagcatagagatatttctagtgtgccttcttataaaggaagcacaggtagatgtttgtctttgtatggttgtaattaagcgccaaatgatgtcctccattcccttagtgacctaggaagagaaccagctgtgcagcaccatctctttgtctgtttttggaagtgagcccaatgcacttgaccctcagtgctatgagggaccagggggctgacaggtgaaatacagcagggaaggctgcaaagaagccccaagctgctgcgggcagggtgtgtgcaaggcgcacggtacagacagacccaccctgtgtttgtggggcaagccccctgtgcctttccccctctgttgcctctttcagctgccctcagtccttcccacaattcatcccatctcccagcacctgttttggatttggagccagtatatgcaggagagaaaaagaagacagtaaatcgagcaagaaaaaggaaaatgttgtattctggagcagaattacgaatgagtcagcagcaaggtctgacaaaacaaaatacaaaggcagtaaagtaggaggttggctgccaggctggtgtgaagctcggatacctgtttctcagtggccgccagtagaagacagggatatgacaagcttgggaagaaagcaggcatgctggtgtgcatcctggaaaattagttaggaggaaattctcatgggtttcttcctttgaatttcctcctagcaatgctatggctgatttcatttgtttcccagaagatgagctgaagacacataggagcagctattggaattgaaatgtccaagtggagactgaaggaaatatatattttgtaattactcagctatttctggatgtcacagatgtttttgaaacgcatatttggaaacacagttgaaatcacaagtgaaatttttattgttcatctcctaaatgtaagctttttattttatttagaggcatcctcggttttaatcatcttgttatacttagatgttctcctcttaacgactcattgcaaaaagaaggcattctatgtgaagggtacagagaatgcgagaaacattctctatcaatgacctgaacaactagggattgatcagaaaagaaggaactaaggtataatagcgttgggtgtggtatggaagtagaagtcgtttgagatacatatttgaagaagctacaggttcaagaagaactcaccatttctactctcttaaatgtaagttttgtgaaagaccagtgactactataagttagtttattccaggaggagagaaagagctgagatataaatactgaatcctaaggatttgtccattatttttgtgtttggaatctgacaactgtatgtcttctatattttaacccttgtataaatggttgcagtaaattgcctagagcagtgaaggaaagatgtgcagccaagggaaagatcaagaaccttcggtttacatggagctatttcctaatatttgttttatgtcatatgagctaaacatctttaccttttactaaatatttcaaattttatctggggtccattagaaattttttctttttttttttttttttttttttttttttttgagacagagtctcactctgtcaccaggctggagttcagtggctcaatcttggctcactgcaagctccgcctcccaggttcaagctattttcctgcctcagcctcccaaatagctggaactacaggcacccaccaccacgcctggctaattttttttccttttttttttttttttttttgagatggagtctcgctcgctctgtcgcccaagctggagtgcagtggcgcgatctcggcttactgcaagctctgcctcccgggttttcgccattatcctgccttagcctcccaagtagctgggactacaggcccctgccaccatgtccagctaatttttttttgtatttttagtagagacggggtttcaccatgttggccaggctggtctcgatctcttgacctcgtgatccacctgcctcggcctcccaaagtgctgggattacagacgtgagccaccacgcccggccttttttccttttaagtcattataacaagacgtttaacttcatgcaaatggtataaaatatattggcaaggagtgcagaaatgtttgccaaatatggtcattaatatgggggtgactacgacctgcttgagagaagagaagggaagacttctctagggaggactgattcattcaggaagttttccatcatccttcaacttccgcatcaggacttacagttcactggaccatcagccacaggagtgggcccagacaccagacaagaagtcagaagttttggcaagatgccgggtctttgggtgagtgcccagtgagaggtacaaatgcaacaggagtctgacgccatggagggatgtgacttctgcagaatcttgggaagggggcagtgtgggttttgcatgtgggagggacttaaataacttttatcacagccaaatgtgacatgctaaggcctgaatgcatttattcatggttcaggcagctgtagccaacaacaagaagcagttaaagttatgtacccactgagagcagatagcggggaggcagaggtcagcacctgcttgcctgggagctgcagggtttctgagcgggaaggaatgttagtggttgctggttccatctcaccaattcctgcattcctgcattctgaatgcaccaacaaatggcttccatccttctattaacaggggctgttgagccttttcagtgttgaagtatttcagactaccaaaagacagtttcatggttctgaaatctatttccttctaatgtgtacttgtcagccttattcttcccatggaagcaaaagagaccaggcctactgacatgcatgtactcatgaagttctctaaaaccttaaagacatctatccctctcccccgggtcgtctcttgtctgtgcagaatacttccacttgctccaagcatctctcaggtagctttgtttccagactcagccaacctggtcatcttctctggagtattttggcttattggtctcaccactagaaaaaagtgacaccctcaactggacctgttacttcaaatgttaagggagaaggttttagacaagataggacaacatgtcttcccagaaagaccttatgagctgggtagctcttgtctccgcccacattattagagatgagctcgtttattttaactatccaaagaaggatctgggtggaaaatggggaaagtctgcttctgcctcccctgccctgaatgcccacctgataattagcccttccacaaagcgagtccccaggggcttcctggaagcacagcagctgctacatcgtgcaggaccatgacagtggatggaattaattactaaaaccagccaagaccaagattaaggaagataccatgtaaatgtggcaattcgcgaagtatttctgaaaaatgaggcatctgtttcctggtctcacctctcctcatgtcaggtgaaaggtgtggcggggaatgggggctgtaattcagacttaactgtttgattgatcttctcggactcctcaaggttatcagagtaaaaaaaggaatatgtacaggacattgctttcatgaagtgtctgtcacagtccacaaaacctcggcttggattgtgaaagcagattgttttctgtctcctaggggactgtctattgtgttaatttccagatatggatatgactgtgccatctagcacctaacggaacttcttttttatctgttaatgatggaacacttcaaaattgcaagaaaataaaccctttgagtaaacacttcattttctcattttcctcagttttagagccaagaaatagaatattttccagcttctttttggtgcttttatttttttccttcaggttttactttttttcccttctcacccctgacatctcatgcagataactttccttttttttctcttttttaccacccagtctctaaatctcactttcttttctctgtctcatctgccttttctctgtgttaacttttccagtattttcagccttgcttctcattatgttactatattgtgtttctttaactgtgtatgccagccatggggttcttgattctagcttaagaaaatctgactctgggctcatctacacctcctgttatttttcacttcctctttgaatggaattgtaggattaaataaggaaaggactgtggaggtcccctgaagcaattttcctgcaatgcatgcacccattccagaggactccagtggtgcttcgagcccctgctcatatgctatccatgctggggagctcaccacctcagggagaccatccatcctcatacatgctctaagtggactgcactaatgctgaccagacacccagtccaaaatcctgggtaacaatctcagtcattgaaggcagctgcaactctgccattcttaatgggattccggtttgccaagagccccagagagtagaaaagtaagagtttcgtggactctacacaatgctggtaactagatcatgcaattctcagaatttagaaaagagtgttttttattcctttcttgtgatttgaatttcctcacaacccttagccctgtattacacaaaaggaaactgaggctcagataagcaacttgtgcaagttcacccagcaagtgaataacaggctcagatgacctctgcgccttactctaaaactgcctaatagtagtagctgtgtcctactccagagctacacctagccaccctcttctgctggcctcagcctggtgcattgttaggaagggaatatctgaggtgatgtggaggagggaggggagcacaggcaggccagacaggggcaactttggctactccagcatcccaaactagggccgtgctagagggtagaaaacgtggtgtaaatttaaggggcattctcaagttacaaagtcaagtgaaacttggtaatcatgtttacatggacagtaaggaaaataagcaaggggaatggctgatgcgaattccaatatttttctgtggaaagaccaggtacatggaaggaaacagagaattctttagcagaaaaagaatgtatctctctaatgcccagtgatgatgagctttttttcatgtttgttggctgcataaatgtctatgcagccataaaacaaatgagttcatgtcctttgcagggacatggatgaagctggaagccatcattctcagcaaactaacacaagaacagaaaaccaaacaccacatgttctcattcataagtgggagttgaacaataagaacacatggacaccgggaggggaacatcacacactggggcctgtcgggggatgggaggcaaggggagggagagcattaggacaaatccctaatgcatgcagggcttaaaacctagatgacagattgatgggtacagcaaaccagcatggcacatgtatacctatgtaacaaacctgcacattctgtacatgtcccagaacttaaagtaaaatttaaaaataaaataataaaaaatttcacctaaaaaaaagaatgtatttcattttcaaaatattgaatttggggttaaagtttggcataaaaacatccatgtggaaaggtccagcccaagctaaaaatataagtttagaactcagaagatacatgaagcataaagacgtaaattcagtaggaagctgtgtcagaaagcagaaatgatggggacctgccagaccaaggcttagaccagtgaggaaggagcccctgggatggcaggttggtgcctgccttccattcgggtctgcagcagcaggagagaaaggtgaagagcctggatggaggggcaggaggcgaaggagagcaggtcctggaatcaggaaaggggaacagctcctgttgccttcatcacgtgctgcaggctggaaatcagaaagatgccacgtgtttggtagataagggttagctgggagaactcattttgagaatgctaggagtatattgcagtgggttaaaagtgaatagaaagtgagccagtgaagcagtgtagactttgcttgtgaagggccatgatagttacaagaaggaggctgggtgcagtgtctcatgcctgtaatccaagcatttgggaggccgaggcaggagaatcacttgagcatgggaggcagtggttgcggtgagccaagattgcaccactgcactccagcctgggcaacagaacgagactctgtctcaagaaaaaaaaaaaaaggaaggagcagttccaagggaatatggccagaggttttttgtttgttttgtttgtttgtttgttttcaatgagggagatttgagttatattctacagaattagaagaagtaataggggagaatgagtggttagaaatgtaaggcacagtggagaagttgttaaagttcaacaagaagcaggagggtatgagcttagtcttgcaaaggaagatggcagtttcaaaacgtcagccggattcaatttaaagcttaattaagcagtgaacaatttgcaaattgggcagcctcctgagccacaataggctctgagactccagtgcagccccatggtggtagaagatttatggacagaaaaaggaaagtgatgtacagaaaacagaagtgagggacagaaacagctggattcgttacagctcagcattcaccttatttgaacatgcttcaaacaattggctacgtttgattagccaaaacttggtgattggcgcaagagtaggttatggtctgtttacacctccactggttataattcacaatgtgcagagaaacctttaggctgaacttaaaacatgtaaggaggcagctttaggctaaacgtgacttaacggtagcttctttgtaggagaggaaggatggaggagaggcctgacttagggcacttgacctaggaaggaagagtagaagatggatttgagaaagacttagaaagttactgattagaaattgggcgctatttgattgaattggagtaggggaagcaaggggtcaaagaatggagggaaggaaaactacattttcaactcagcttactgagtgcatgatggagctaccaactgagatagggattatcaaaagggagcaaggtttgggggctgctgaagagtttattctggagcaaattgagtttttggtgcctgtgagacataggatgcagtcatctgatatattggtctgtagctggacctgtgggagttactgatatttaggtaatttaggttacggtttaaaatctcaagaatggaagatttcataggggaggaggatgtaaagggagtagatgagtggccaaagaaaaaactcagtgtccacgatggtacagagaaagaaaagaccttagaaatctaaagtatgggtccatcggagagaaggaggggagagggtagaaatttcctgactagagggaaattttagagagataagaagcagaccaaatatgaactcaccctgtgacaaatcctcaactgctttctaaaaaattattgaatgccaatgtcaactattttgtgtgtaatatattaaaaaaataatttgctgaaactgtttttccatcttgtggatagtgttttgggaaataagttctcctttattcattttccaggagagatattaatgtaatgctataggatgagactaaaataactcatattcatgaacttctaaaaaatggcactcttagaaaaataactgaaagcagccttactaatttccaatctttgtattttttatgatcagaaatatttagtctattttattttttatttttatttttatttatttattcatttagtttttgagatgaagtctcgctctgtggcccaggctgaagtgcaagggcatgacctcagttcactgcaacctccgcctcctgggttcaagtgattcttccacctcagcctccggagtagctgcgattacaggcacccgccatcctgcctggctaatttttgtatttttgtagagatggagtttcaccatgttgactaggctggtcttgaactcctgacctcaggtgatccacccgcctcagcctcccaaagtgctgggattacaggcgtgagccaccactcctggcctagagtctattattttaaagaaagaaacataaatacaacattgaccacagaaaaagaaaaagactttatctctctaaggaacaaattctttcagtgagatgcagctttcttagtgcctttctagataaaacattgtacaaatgaaaacgcttcaatttgcactctttaaacagtcattccctttgtgcctgcagttcttttggcttgatgttgaggaagattttgtggaagacaatgatattttattgcttcatcttggagcaaggagaaaattgtttctcttcttcccacttccccattttttaagagtagtgctcgagtcacacttgcacttccacgctgaagccttctatttgtatcaacagtgtgttctggaatgccactttcacattcccacacttggcagacccagcttctcaggttttctctatttcttgactttattcatttttgtttcagcctttcttttttttttcttttttttttttaattatactttaagttttagggtacatgtgcacaacatgcaggtttatatcatatgtatacatgtgccatgttggtgtgctgcacccattaacttgtcatttacattaggtatatctcctaatgctatccctcccccctccccccaccccacaacagtccctggtgtgtgattttccccttcctgagtccatgtgttctcattgttcaattcccacctatgagtcagaacatgcggtgtttggttttttgtccttgcgctagtttgctgagaatgatggtttccaccttcatccatgtccctacaaaggacatgaactcatcattttttatggctgcatagtattccatggtgtatatgtgccacattttcttaatccagtctatcattgttggatatttgggttggttcctacccaaaggattataaatcatgctgctacaaagacacatgcacatgtatgtttcagcctttcttataggcgattccattttccagatattctattctagtccccatgcatacattttggttttgatttggtttggtttgggggtttcttgcctaacggtacagacgaacaattaaaagcagttctctcctcctcctcctcctcttcttcctcctcctcctcctcttcctcctcttccccttctccttctccttcgtctccttcttctccttcttcttccttcttctctttcttcttgccatggccttgatagggttattttaattgctctccccgtttcttatgagcaccacttaaaagatatccacagagctgaattgcaggggtgtgtagtggtatattcaaagatgaatgtaaagatgtaactctaggtgtttgttttggggatggcataaccagggaatgaatttaaatcactgtttctagatggattaaagcaatggaccttcaaccaggaaagatggcagctattcttactttgcatatttattatatttgttgctatactgaaattttcagctgacaacagcgaacacggacttctgacttgagagttacgagatacaagcttggttcaggcaatttccaagggattgtttagagagagacagaactcaggtcaaatcccacttgactttaacttaaattccttaagattttattttcctacctgtacaaataggacaataatatctgcctcataaagactaaatgagttcttgcatggtaaggagctgtcagagtacctaatatgtggtacgtgctccataaatgccacccacccccaccacccacttcagctcaccactgtcaccatctctgggacttggcttggctgaagtaatatcaaaggcttcctctgagtgcttcagtctgtgagtggtcctctcccagcccctcaccacctctgtcctgatactattttaacaaggaatttatctgtttgctttagaagttgctggaagtttacaaagaagaaacccagtagttcagaagaaacgtatctaaatctgattttaaaattatctgttttctctggatttaaactagctatattacttacctattgctgtataagaaattaccccaaactcagtggcttaagacagccaacatttaatcttgcagtcactgtgggtcaggaactcgagaacatcttagctgtgtggctctggctcagggtccctcatgaggccagcatcaagacattagccagggttgcagtcatccgaaggcttgaccggagatggggaacccatttccacatccactcacatggcttctggcaagaggcagtctaacgggtatgagcctcagactctccatggggctgcttgagtgtcctcacaacatggcagccagcttcctcagagcaagtgatatgaaagacagcaagaaggaagccacgatacctcttataagctggctgcagaagcctaacaccctcactgctactgtattctgttcatgagggtcactaagtcagccaacactaaagggtacagaattaggttccatctcttctcttctctctcctcctctcctcttccccctttctctttcctttatcctcttcttctctttctgtgcctcagtttcttacctgaccaaaggtaacttctgccccctagggatgctatgaaaacaaagtgagatcaatcatatgaaaaggcggttttggagggagagttcagaaactctatataatataccatataccataaccatggaaacctgagatcagctctgtctagcttcctgctcttgcatctgaagaagccgttccagctcacacaggcatggcttagtcacagtgcagcatggggtcctttaatgggtcctctctgagcggtgacctgctcaggacacaggagccagcaccaggcccttccttccttctcctgggcaagcagcaccactcatcccggcagaaatagaaaaaggagttaagttcctgtgttccttattagattgctgtagcagctccataaagctctcctagacagtcctgtctgttagtggctgtttctttatgactaaagcagcactttcccatctgctgccctcaaagcaaggggccccgggccgcatatttctggttcaggagtctcaagatctctgaaagcaccagattgttgggatttaagtgctgttgtttatttttatatctgggtcctgttcctccaaataactccaagaccattgtgattttcgagaagttaattcagtggtgcaggctaggtagggaatggtggtattagcaaatcctacctgttttctttgcaagctcatttccatcattggtcctccaaatgcatttccctgttcaaagtactctaccttggatatgtctgcctttgcctccacgtccctcacctattatctttagaaaggtggttttaaatgttggtcactgaacatttagccacatagggcaccagctctcagaggtttcacaagtaaaggaaagggttgggggaaatgaaatatggttcaacgcaacagagtaacccacatattccgtatgttcgacaaggtctctacccaggaggctggcgatgaaggatgctaacatttcttgaaccgccatcttctcccttcttttgggtaaccctcgaattctgcttatggttatctatggattgtggagtcatttcctggctcaggaggttaagaaaggcgtccgagatttgagggttacaggagtttggaagcactgtttttctggttttctgttacctccattttaaagccgtgatacttccaactgcccttttttcagtaagttcttgttgactactctcttgaaaccaaaagatgcatatcccgttgtacagggggtcaaaagtgtgcccaattaagcctgccttgacttcaatattgcaactcactgaagacacacagtggaatttctggtggaccccttcccataacccacagggaactctagccgtacatgggtcttactgacccgttgggtctagctgacggtgcctgatggtctccaatgaccaaggtgtcctcattagttctgtgctatatttagttaagcctgaaatctgtgcccctaatttaatcacacaccaggtagccatggagatgacatcaagcctctggctgccctataaaccattgcaaatgctgaaaataaaataaacaggatatgcaaattgacttcctaagtaaataaaagactttgtctccaggtgttgggattagctgcttttggttcactgatgtttgttaggattcacagtgatttgaaaaatatcatcgtaacagcctttgtctcaatgcctaccttttttcctttttgtctgttgcagatatatcaacactcgtatactggatattacgtcctgagcaaaattcctcatgggtaagagtgttcttttctttcttttaattagaaatatgcagggcaaagtgaagggtagaacatggacgagctgtttaacccttagggcgggaaatggcgttccagttctcacagccaagggtgctggtatcgtggcacctctgggactctccctagataatgacactaaggatgtcagggggtcacttgagtccactcacttccccatttgtgaagcccccttcctagagcaactctgccctcttcctgtgctggttcctgcagttgaccctggaggttcttcagagccggacattcccctctgctttgtaatcacctgcagcctcctctcaggcaaggtgaggtggcccttggcctcccacgagggttcctggttatacccacactagcagaatagaagcctctctcagcccaccacatgtcatcagagacaaatctggaacatatctatgggattacggtaaactactctggtcagacattcagcagtgcattgggaatgggttgggcaagtggtattagtgctgctctacccatcactccgagggggtttcagcggcgtgttgttcttgttttattgtcctttctgagcttggctgtgctcccagggccgggtttcagtgcctgcttttgactgggccccccggcttcattctttcatgacctcacattgcactgctaacctcatctggtctctcaataatgtattgtccagagcaggagcgagtttagttttcagtgctgggcaggcgtcccccacacgaccctcagatgcctgatcagcttcacctttggaacccagagcagaaaagacattggttagggtttggtgaaaccacatgttgagtcagacacagatgaaaaatggttgcagaactaggaaagtctgtcgaggagaattttttgttgttttatcttcattatttcttcgtctcctcttccctcctccttccctcccctattctcattcccttctcctggccttcctgttccccacctcatgtttctctttcctgtcttctgtggtttctactgtcatgctttgcaaaggtgaggtgctcaggaaaggttgataaagaaactgaattgtgctgcagatagtgtcatgtaggctcctgtgaatatctaggttgaggcatcctcatttcccaagcaaattttaacagcaggagtggctagaaagcatttttccataggtgagcattaatcacagcatgagcgtttatagctgctgctctctgttttctactcagcttagaatacaggcaagtccttggaaaacaaactcgaataaactaatttaatgtgggctttagacaaagggaagacgcatgtggatcttcagcaaattgtgaccaatagtttctgttagattattagaaaagtgaagcccaaagaaagcaaagatggcccaagttgcaaaaataaagtattcatacaaatttttcattaaaagtatgttttaaatagaaacccaaatattcttcagtaaagaggaattatcccattctttcccaagcagatatatatcttcagaggtcatggcaggcaggactataattatgccttgagatttatctgccccttctgggaacaatagaatttgttgtagatgatagatatttcgttccatcttatatcaatttgtaaaactcgaaactctaaaagcagttgatgcctaacgtattgtgttaatattttactgcatcagtcagcatttggaggaaacagattctaggaacttggcacaggagtttgctgaacaagctagcaaagctcaggccatgatagtctgtgttgaaggctcggcttctgcacttagatacctggagcctggtgatgatctgccttatagatgaccccaacacggagggagctgcttctggtgtctttaatggaatcagagcaagaataatgcccctggtttattggttagctttcatatacctttatccctgttcaacaacctgcaagaaaagcatccttatttccattttaagtgagagctccaagaggtcatcaccttcccctcacctcctagctactgtatgcttgagtctcagcgtaagtcaggctgactcgaaatcccatgctagtaaaaaaactcgtggctcacacctgtaatcccaacactccgggaggccaaggtgggcagatcacttgaggtcaggagtttgagaccagcctagccaacatggtgaaaccccatctctactaaaaatacaaaaattagccaggcatggtggtgcacacctctagtcccagctactcaggaggctgaggcaggagaatcgcttgaacctgggaggctagaggttgcagtgagctgagattgcaccactgcactccagcctaggtgacagagtgagactctgtcaaacaaaaacaaaaacaacaattgggattaattcaaaggtcacaatgcagagaacaaacgtgatagctataaagatgagattttttagtgacatactactttctcttcctagggttcttataggattgaaagatgtagcaagtacatttattggaaaacaacctctgggggtgccaaagtcagtgtcccaccctgtcaccatgtcactgaacacagcgcccctgaagcggcgttgctcaacctgctcaattcttcctctttgtcataaggccattgatgagaaattagccaattaattcattgcaaatattgtcagagtcttatttgtcttaatgagacagtggatctctgagcggtatctccgtaggcctggagcttcgtgaccccttggtcatcactgtcaccggtgtgcgtgctccaccaggtggcagaaaaagaacacagcccggagctctaagtctgaggatctaggtgggttttggatagggaggaaagcacaattgtcttttaaaaataaaaatgtccctactaaaatatttgaatatacattattcatgtagaagaaaactaagagattttcttaatttagaaaacacatatctgtacctttttcactaattctcatctttcctttcctcgctcctccctctaaattaaagccagaggccgtgcaatcttcaggatggttttgtcatttatagcttgatttttttttcttagcttcagtctttgcaaccagccagagaaaatggtctaattaatgttctcatgccctctgatttctgttgtccttccttttggcaaatggcaaaagagtttcaggacggactacccctttcccatccccctctcactccccagtccccgctgttagcttccttcctccgatggctgtgacctctatagctggggccaggtagagttctttctgtgtggaaggtgggagttgcaatgagactcccaagacagctgaattttgatataatcaaaaatctattacctaagggtaggtttgtttgactttgacataccaagcttccaaaaattgtattcttaaattgtatcctaaaaggacatatgccttttacaacaaatctatattttagcggaactaaagctagttatttttaacataaagcatttcactagaagtttttatatcagaattttaataaaataaggaatcttccatggtggagtcaaggatctgttaggtgtttccatataagtatttttgtagacttggctactgcatgacattttcctggcatgacttctttttctagaattagttttgtctttatattttttagggtctaaagccaaaggcaaaattatctatatttatgtctattatctatctacctagctttctatctatctatacacacacatatacataatacacacttttaataatagtaataatatatttctaaaatgtagtctcatatccaataggattgttctgaaagacatatggacttttttctataaccgaaatcaatttgaagaaaaattggtcctatcactttattatgtaatgttggcaattaggggtctggcaaactcagaactgtaatagaatagaaactgctgggtgttcaaaggcatttttttacgtgactggccatgttctgtggatattgttgctctaactttgcttacctactcgtaattttcaggcaccaaacaaaactgtgaaaaaattgtgttcctttagaattgtagttgactttttaaagccatattctgtatctgtggaaataggaaactgagacatcacttccttctacctggaactgctctctaagtttatagactgagatccagaggagcattctgtttatttgggaagtagatatctaggtcgagaatgtacagtgcccagtgccagcctaatagcatcatgccaggcagtgacttagaccctgcagccacatagacctgaacttgaacccatcgtgctgctgacttctggttgtgtgaccttgagagttgttctacttccataggtcttaggatccatataagaagatcataataatagtgcccactttggcctggcatggtggctcatgcctgtaatcccagcactttgggaggccgaagcaggtggatcacctgaggtcaggagtttgagaccagcctggcctgttgcaaaaccccatctctactaaaaatacaaaattagctgggcatggtggcgggtacctgtaatcccagctactcaggaggctgaggcaggagaatcgtttgaacccaagaggcggaggttgcagtgagctgagattgtaccattgcactccagcctgggagacaaagcaagactccatctcaaaaaacaaaacaaaacaaaaaaattagtgcccacctcataggcttgttagaagaattaaatggaatggctgggtgtggtggctcacgcctgtaatcccagcactgtgggaggctgatgtgggtggatcacttgagttcgagaccagcctggccaacatggtgaaaccccatgtctactaaaaatacaaaacttggccgggcttagtgaggctgaggcacaagaatcacttaaacctgggagtcggaggttgcagtgagctgagattgtgccactgcactccagcctgggtgggagagcgagactccatctcaaaaaaagaattaagtggaatgatatatgcaaaacacccagcaaagaattttgcatctagtgagtgattagttaatattgtagtatgtacccaatatatatttgtagtcttataattaaatattatcagactttagtttctagccatcttgaaaatcttttctgttacaaatgaaggaataatataatcctaaaatcatacaattctctttaataatttttctaagctgaggcttgtttcatgacactcaggtaattataatgtctttgtaattttaatttccctcttaaaagaagtatctatggcctcaactgtctacaattctcaatactcaataattttttttatatcatctcattctgaccttctgcaattaactttccagcattcttgttttgcctccaatggaagcagaaaagatactgtgtcagcaaatacttattgaaatactgtctggagcaatgaaagcatggttgctatccttaagaaattaaaaatcttgttgcaaaggaaagatacagacttatataataaaatgttataaagtctgttaagtgagtaatttctttttttttttttttttttgagacagagtctcactctgttgcccaggctgaagtgcagtgatacgatctcagctcactgcaacctccgccccccaggttcaagcaattctcctgcctcagcctcctgagtagctgggactacaggcacccaccaccactcctggctaattttttgtatttttagtagagacggggtttcaccgtgttagctaggatggtctcgatctcctgacctcgtgatctgcccacctcggcctcccgaagtgctgggattacaggcgtgaagtgaggatttttaacactacccaccaaagaaggaggggagggttgaaggtgtcaccatcataaacagtctcaagaaggaagtttgacttgaagtgagcctgatagctgagtttttgtttgtttgtttctttactttttaatagatgacaggagggagatactccaggcagggtaaaacatgaaatgaacttgacctttgcatgagccaacacttcctagaattaatgaggtgccctgccaggctgctgctggagtgttcacgtgggactcagcatgggtaggcatagggttaggtaggctttaggaggtacctagagtgcagacaactgaaatactcagtgtttaaaacccagtagtattggtctttacaataagaacatagcaaccttttggagcagaagaggaatgtgatgaaaacagtaggcgcagattagttttgtgcttatgtatagcatacactgaagaaaaaggaagatcaaaattctggattcaattagcagccaggttggaatggtgggtcgggagctcagccaatgtagaaaccacactaattgtgattatgagtagctggtgttctcttggaaaatgaagacagatttcaagtgtttatattccatgtccctctaattaaatctgtggcagcctgggctccttgtgagttgagcctggtgccatcctgagaggtctctctaccatgagtggtctgtaggtagtgagttcaggagggcagcgatgagaattctcagcacccatgttggttagtgcattcctttccagccctttcttcctgtgtgtgagtctccagggcctggctgctgcacacacggagataggctttggctgtgcagagcaagctaccttcacagctgccggaagttacagaactaggattgtgtgtgtaaactggggaagcaccagtgtgaagcaaaaatgcagaagaaatcttaaaatggctttttttttttttttttttaagatacagagtctggctctgtcaccaggttgaagtgcagtggcgcgatctcggctcacttcaccctccacctcccaggttcaagcaattcttctaccgcagcctcctgagtaggtgtgactgcaggtgcacaccgccatgcctggctaatttcttttgcattttagtagatacgacgtttcactgtcttgctcagggtagtctcgaactcctgagctcaggcaatccacccgccttggcctcccaataaaatggcattttatgtgtctgtaccatggcattgaagaggggagaattccactgttacttgctttttttgttttgtttatttgttggtttttttttttttttttttgagaggaagtattgctctgtcgcccaggctggagtgcagtggtgtgatctctgctcactgcaagctccgcctcccaggttcacaccattcttctgcctcagcctccggagtagtagctgggactacaggcgcccaccaccacgcccggctaattttttgtatttttagtagagacggggtttcaccgtgttagccaggatggtctcgatctcctgacctcgtgacccgcccgcctcggcctcccaaagtgctgggattacaggcgtgagccactgcgcccggcctgttacttggttttatggattttcagaactgtgaacaactcatacatctgcctgtaagacttggtctcagccatttctccctccccttctcccttcccctcctgtcctccttctatccctccctcctgctgaaatccagacttctagtaaccatcaccaaaaaatgtggactttagagtcaaggagatctgggcgtaaatccccagtcttcgtttctacttgtgtagtcatgaaacagttcctttgctcctctgggcacacttactccatccatatattagttgcctaatgcatggggtttatggtgaagtttctgtgaaacactgtatgatgaggtgatgtctttaagggcctgctttggttcatagaaaatactgagggttgccaggcgcggtggttcacgcctgtaatcccagcactttgggatgccaaggcgggtggatcacaaagtcaggagatcaagaccagcctggctaacacggtgaaaccctgtctctactaaaaatacaaaaaattagccaggcatggtggtgggcacctgtagtcccagctacttgggaggctgaggcaggagaatggcgtgaacccgggaggtggagcttgcagtgagccgagactgtgccactgcactccagctcgggcggcagagtgagactccgtctcaaaaaaaaaaaaaaaaaagaaaatactgagggctctattcatggtggacaccaagaccttccataatatggccaaatctaattagccacccttcatcaaatttccctaaatttgggacagaaaataaatctcatactcactgttaactctgaccaattgacaatgacttcctggagctctacatttaaaaatagactaaaaccatgcccaggctctttaggaaagaatgccacaatcagtgagttttgcctctgaggtttctattctcccatccggctgtgtaagaatgaatcacatcacgcaatgtgtccagtcattgctcccaaacccggaatgtgtttctggttatccacacctctattgacttcattctcctccccaccacacgagccccctcccacacatgcgcactacagaaatgtcctggtcattgtgcctctcatactcaaatccttctgacccttcaagccacagcgtcaaaacctccttctctaaaaaaaacctgaatgctgagagtcaatactgcttcttatttcacgctagaatttatcgttttgttagatggctacttccattgttgtagatagaatttttctaaaggggatatttaggaatgctttccatatccatgtattgcttgacttctttctctccgtcattctaagttgtcagagagaggggttgggtgggaagggtgtggactctgcctgtaataccagtagctgttgcacagggtgacactgtgactttgaattgcaaaagtggcgaaagaggctgcaccaacaggtcttatgctctttccaggtgcaggtctcagataacaagctgaaggtagtcagtgactggaatgtcatcggccacctgcaaagggagtcattgcagctactcttttcagtggaatcatttagttccctcagggactttcttagaaagtctaaaagattttcaaacaaacaagtctctttgaaaatgaggtgaaaatgcccaggagtcctcatttggtcaggctccttgttcatcttaaactctacacccatgtccctggttcctgatactgggggaccccataaatgttggttaatcactggaggaaatgaattaaggaactaagccatgctgaggagcaagaatgtgtgtgctggggccccaccacaaatgggttaaataagagcctctgaagagggaacctcaggatggctttgaaggctacctgggtgattttggtgtccagctggggtcatctggcctgctcgcccctttacttgctgcccttgacaagtgacacccaggattgccgtggaagctgagaaataacacttctgtctgaatatgccagtaaagtttcctctcaggcattaatttccttgtccactcaagaaacttggagaaataagggtagatctcagattaaccatgttcttggggatttacttaatgatattcagtaaaggggttatagtatcaaagtctgcagcatggagatgaagcagagccggctcttccggggtctgtccacatcaaggggcaccagacgttggttgtgattgttcctgagcctggccaacctcacatgtgccctgggctccctctggtgagctccggtcttcaccttaaccgcgcatgtttgcattgcggggaatctgtgcttcagacagacacgccagatgttacaggtcactgcatctaagatggaaggtgttctgtttatttatttatgttttaattttggctgttgatcactttcttgtgctggtgaatcagcacgcgtgttgaaccagccattaatctcctgggagagagctgttgacatcctggagggtggcactcttcctgtttacagatgttaaagagaaaggcccatgggtgtctccctgggtggccaagcctggttcatgtgtgtgctgtgctgtgtgttccttcttccacacaatcactgagcctggccgggcacagtggctcacgcgtgtaatcccagcactttgggggaccgaggcgggcagatcacctgaggtcaggagttcgagaccagcctgaccaacatggtgaaaccccgtctctattaaaattaaaaaaaaaaaaaaaattagccgggcatggtggtgggtgcctgtaatcccagctacctgggaggcagagacaggagaatcgtttgaacccttgaacctgcgaggcagaggttacagtgagccgagattgtgccattgcactctagcctgggcaacaagagcaaaactctgtctaaaaaaaaaaaaaaatcactgagcccctcgcaagtgccaggcctgatgcgaagcactggggatggatagggaaaggccccacctgtcccttgctgtctagtttattttgttttgtttctacgtcacctcctctctcccctgtgctcctgcagagggttggacacaaataccccactgtgtctgcgctggggacattggcctaaatcaaacatctagggcagcctcagccaggaaagggcatcactcaaggagagggagcaggtcagtctgtctggatagtggtgggaagagcatacaccaacaccaactgtacgtatgtgatttcaagtttattgtggtacaatttacttctaataaaaatcacgctttcggccgggcgtggtggctcacatctgtaatcccagcactttcggaggccaaggtgggtggatcacaaggtcaagagatcaagaccatcctggccaacatggtgaaaccccatctctactaaaaatacaaaaattagctgggtgtggtttgggtgcacctatagtcccggccactagggaggctgaggcaggagaatcatttgaacccaggaggcagaggttgcagtgagccaagatcatgccactgcactccagcctggcaacagagcgagactccatcttaaaaaaaaaaaaaaaaatacactttttaaaggcatcgtttagtaaggtttgacaaataggtgcaatgaatgacataagctccccacaagcaagactcagggcagtcccacctgcccagagcatcctccatacccctccacccaggcgagcgctgccatgccatctatcccacacttttgccttttgccttttctggaatgtcatgttgagggggttgtacagtgtgttaccttctgcagctggcttccttagcataattgcttttgagattcacccgtgttgtgacaggtgtctgcattcatttgtttttcactgctgaggagtggtctgttgcatggatatcataatttgtttcttcattcaacatttcattgatatttgagtgtttctaattcggggctagtatgaataaaagtgctgtgcacatttgcacacagattttcatccaacgtgttttcctttctcttgggtgaatacctagatgtagaattcccagatcataagtaaatgcacctttaactagattctaaagtgcccaactgtcttccaaagtggctgcaccattaagaactctgcctttttcttaactcactaccccaggactgacttttttgaccccctgccctccgcccggtcactgtgtatggcaggtggaatccaccatgccctgggggtggttccacctgcagctgtggggagaagcatctgtgctcactgcacatagatctgtgccctcaatgccagcctgcacctgcctttctctacctggcacctggggcctcatgggggatggtgtccggcctgcaggagcagcagcctgactgtgccatctctcatctctccaaatgatctctctgtggaactttctaaatgacatatcagccgcgaagacaaataggaaataagaggcaggaggcaagacagacactccccatggagcggattccacgtggccctgggcactcacctcaggagtggttgagaaagcctggttcctgcttgctccatgaagtcctcactccttgaccagattttggagagaggaaggtttttcaataactgcccctcttggtagtcctcctaaggaagagcaaaagaaataaaacagattcaaaactgtgggcctgcgcagtgattcatgcctataatcccagcatttggggaggtcaacgtgggaggatctcttgagcccaggagtttgagaccagcctgggcaacatagcaagacacccatctctacaaaaatacaattaaaaaattagtcggatatggtggcacgtgcctgtgatcccagaaacttgggatgctgaagtgggagaatcgcatgagcccaggaggtcaaagttgcagtgagctctgattgcaccattgcactccagcctggacaacaaagcaagcaagaagagaggagaggagaggaaaggagtggagaggagggcagaggaggggaggggaggggactatgcatatcccagtagcctggctctgggctgggtctgtctgttgcttaaaggcttaaaaaaagagcacagagccatctgcacttggacatcctggtgacgtggcctaacttccgacattggggtcctgtaaaagaagataagccatggtgtttccttaatgagaaggccttaattccaaagtgagggctggcaaacccaacagcacagcactcagaggagaagacacagttgttgattgagtcgagctgtctggcttcccaggaccctcagctcagtcacagcacagcgttaccaggatgtcagacacccaagggcagtgctgacatgcagcctgccactgtggccacagcactcgggttaaaaagaaaccagataaaattcgtgtttctgcttgtccagactagaaattaattcaaacctggcctgtagcagctgtcttctctacatccaactggatggatgaaggccgtcctacctagtagagggaggttggaaggatgagaactgtctacaattaaccttttcattagcacagaaaatttagacaaccaaggtcccaatttctaatgtaaaggtcaatttcttacatctctgtgtacatcctaactgattcaccacaccattgcccgaaggtacatttctattggttttttgaaatgctaagaggagctctcaggcagtgttaatgtatgcactcacgacttcataggtaccagtactgcactagcttccagtatagcactaggtactagtactgcactagatactagcactgcactaggtactagcactgcactaggtaatagcactgcactaggtactgtggatttgaggggtcagaggggaaggaaaccattctgattgtcaaggaatttcctatatagttacagaaaccacattcattagagaatgagtaaattacctttgtgctcctattagactacataagaattgtacaatgtgatgtcctggggttacataagtatagttttaaatcaactatatctgcagcctgtgaaaaacctattccccttttttcctagttgcagttcactccccagttcgtctgcaccctacctcgatgagatctccccttccgtgggctaaacaaaaccccaagcagttagctgttaatgatacgagcaccatgccggagctagggccaaatgagtcagaagaatcctttgcagtgccgcggggccctaattgtgtcaggtattttgcccaaattagcatggctgaggatcggctgctggttctaaaatagtctcgaaggactgtctccaaattgcttcggcaacattactcattctcagcacgactctggtttccgccgtcccaatttacagatgggcagccgaaagggaaaggatgagatggctaaactgaaagtcacaaaggaaatcctgggccaacatcaccccttggggcttcctccagctgcggtctgtgcccccacagccccaggatgctgggcggttttctccaagaattggaaaccttttcccagggcatcctcacacaaagccccactctgaataacacgatgatttcaggcctttttctaatcataagcccccaaattagataagatcaacatgaaaggtctcaggtatcccttaagaatttaaaggaaggacagaaaaggttgagctctgtagtgcgtggaagaggagatggcatgatcaggatactgtcctgagaattagcagtaggatcttacagtgaaatagggggctcctccgcaggctcccaacacatcagctggtaattatgcccggcaccaggatactggggcaaggcagagccactggaacacatcctcgcctgcaccctgctctgctcattagccatagcatcaaaatcacttttgctccaaaggcgttttttttttcctatactgtacattcttttgtgctttctaatttattactttttttcccctacctgagctgttggagatttagtgttgaatggcttctctgtatttttctttagtctaattcattatcactaagtctgtggtttttttttttttttgtgatcaatatacacacttagattggtttaaaataatcccatggagagcctcattagtgtccttggataatagatgcagctctctgggagaagggagcgtttatcagggaccacagtgacagagcccacaagcacacctccctgtgtgtgtgttgaacatgctagaacatgcacatgtatgttgtcaggtcctcaggctgcatgaagctgctacatgtgcaccatgtccctgctgcgtccctgctgttcgttctgagcactgtgagagcctgaggcgtcagagtgcagctcattgagacccagacgccactagattctcagtcttctgcatgtttttcacacctcttatgtttactgaaactacatcttgagctgagtgtttgagcaatttgttctcaaggccaatatgggcaaactccctgagtcggagctgataccagcgaacggcttcagaaagtaaaaaacatgggaaagaggctgagaggaaagaacgctctgagtgggaagagaggagggagcacctgtctgaactggctccgttcacgtccattcattctttaaggaacttctctttgtccttcataaactacagtgttcccctgtctcccaggctggggtctcatggctcttgccacaggccaaaaagaaataagatttcctcttggcaacattttttgttctgtaatgggattttactgaaaggcaggaggaaaaagcccttgaggtgaccaaaaacttgtttttaacacatatgatgtaaggtaaaagctttaagaaggtaaacagagctgggcatggtggcacatgcctaacgccccaacagctcgggagaccaaggtaggaggatggcttgagaccaggaggttgaagctgcagagagctatgattgtgccaatctactccagcgacagcatgagaccttgtctctaaacatagatagatagattgacagattgattgataaatgatagatagatgatagataaatgatagatagatgatggatagatgattgataggtagatggatagatgacagatagacatatagctagatagatcaatccatggatgatagatagatagataatagataaataggtagatagataaatgatagatagatatagatagataataaatcaatccattaatggataggtgatagataatagactgattgattgatagatgatagactgattggttgagagatgattgatagatagaaaacaaacctgttttttagtttcttcacagagtggcacaagcatcatctcattccattttagaacattccacccccacctccaaattatgctttagcatttactgaaccccccaaactcatttctgcttccccgtcatgtcttcatttcacagagtttgttgagcactgatcttgatattaggtttacagtgacagagaagacacaagctccctttaattacaaagattccatttccgtgtgactgtgtttactacggtcagccctccatatccatgggttctgtatctggagattcaagcaacctccctcaggtcaaatacctggaaaaaaaaaaaaaaggatggttgcatctgtactgaatttgtacagactttcttccttgtcattattccctaaatgatacagtatcacagctgtttacattagcaattacattgaattagggattataagtagtctagaggtggcttaaaggatacgggaggatgtgcttacattatatgcaaataccacacattttatatcaaggacttgagcatctgtggattttggtatctgcaggggtgtcccggaaccaatcttccatggataccaaggatgactgtgctcatatttgtgatcatatatgttaaaagcatctctctgaattagagagggaatctgtcacatctgtcactaatattttagaacaggccaccccgatccatctttagtgagtggagcatctctgcctgaaaacatctatatccaaatctttctttctttctttctttctttctttttttgatacagcgtctcgccctattgcccaggctggagtgcagtgacgtgatctcggctcactgcaacctctgcctcccaggttcaggcgattctcctgcctcagcctcctgagtagctgggattacaggcgcatgccaccacacccagctaatttttttatttttagtagagacagggttccaccatgttggtcaggctggtctcaactcctgaccttctctgatcctcctgccttggcgtcccaaagtgctgggattacaagcgtgagccaccgtgcccggcccaagtgtttcataaggaaaggaacttctgatacaccatagagtgtctgggaaaattttaaaattactaatggaatatgtgctcaaatattggcccctgaggaagcatttatgcccatgaggattcctgccctcaaaaatttaactgtgtcatttagatatacacaaaaaatgaatatatatgaatatttaaatgctacatgagtttaaggtattactgaccctagccactcagtgactggagattagactagacccacttattaatccacccatccactaattaattattcaattaatatttattgagcatctaccatgtgtcaggttctcttttagaactgggagtgtatcacacatttttatattaccttccatgctaagtacataggaagactcagaaaacacatatgattagacactgagaatgctattttttggtgcctttggtgataaaacgttaggatccaggaaagcaattgttaggtttgccccctcactcccaaatgctgttgctgttataaagcttttcagtccctcaaaatcacttaggaagataaatgagtaaacttcgctgcactaatttactcttcaaatttcagcatgatttatgccctgttttgtttattgctcaaataagcaaaatcagaatggattgtgtgattattttgaaatatagttaagtccagatcactttattcttccttcatcatttttttttaactaatccatctctacccaggagatgattcatcacacagctgccagggctgctttaaaataaaggaataaataagaagaaagaaagaaaagtgaaggagggccactacatagccccaaagtaaatcactgtacaccttcctgcattctctttctctctgcctgtcttcctctctgtcacacacacacctctaagaatttcagcagaatccgggacatgctggaaaatcatttgatgcgaggaattggggcttaagccaagtgtgctgccgtggcctaaatgtgcaaggtggggccagggacttctcccgcaggaagccggctcaggccagaagcccagggggtgggcagggcaggggtcatctcccccagggtttgcctctgccttgctctctgagggtctccactttgtcccttcaggctttgactaaatcttcacgcagacactggtcagctacctggccctgagcaagtcgctttgggccttggtggaactgggaaatgaagggacattcgcttcctagggctgcggtgagaaatcgccacaaactgcgtggcttaaaacaacagaaattgcccctcccagttctgaaggccagagatgtggacacagttgaaatgacagtgacagagaagggtgtggaggagaggagcggggctgcggtcacgcccaggacactggattttaaagggtgggcagagaagatcccacagagacgaggaccagagagggaggtggggggagagctgggagaaggggcagtcgagagggaggtggggggagagctgggagaaggggcagtcgagagggaggtggggggagagctgggagaaggggcagtcgagagggaggtcgggggagagctgggagaaggggcagtcgagagggaggtcgggggagagctgggagaaggggcagtcgagagggaggtggggggagagctgggagaaggggcagtcgagagggaggtcgggggagagctgggagaaggggcagtcctgaacatcaagacagagaagcagcagccgcagcatgtgcagggagagaccacccaggcccagcacggggaggccacggactttggcacctcgatggacacagaagatcttcagagaagcaatttcagctttaaaaatggatggaagccatattgcagtgggttagggacaggagagaaggtcagaaagtggccctcagatttggaccactcactggattggaccaagaccggtaggcgttgggctgatgatgggttagaggctgcgtggggaggaggtgctcatgggtgggtggagaggctgcgtgggaggaggtgcccagagatgggtgagaggctgcgtgggaggaggtactcatgtgtgggtggagaggctgcgtgggaggaggtgcccacagacgggtggagaggctgtgtgggaggaggtgcccagtgatgggtggagaagctgcgtgggaggaggtgctcatgggtgggtggagaggatgcgtgggaggaggtgctcatgggtgggtggagaggctgtgtgggaggaggtgcccagagatgggtggagaggctgcgtgggaggaggtgcccagagatgagtggagaggctgcgtgggaggaggtgctcatgggtgggtggagaggctgcgtgggaggaggtgctcatgggtgggtggagaggctgcgtgggaggaggtgctcatgggtgggtggagaggctgcgtgggaggagatgctcgagtgggtggagaggctgcgtgggaggaggtgctcatgggtgggtggagaggctgcgtgggaggaggtgctcatgggtgggtggagaggctgcgtgggaggagatgctcgagtgggtggagaggctgcgtgggaggaggtgctcatgggtgggtggagaggctgcgtgggaggaggtgctcatgggtgggtggagaggctgcgtgggaggagatgctcgagtgggtggagaggctgcgttggaggaggtgctcatgggtgggtggagaggctgcgtgggaggaggtgctcatgggtgggtggagaggctgcgtgggaggagatgctcgagtgggtggagaggctgcgtgggaggaggtgctcatgggtgggtggagaggctgcgtgggaggaggtgctcatgggtgggtggagaggctgcgtgggaggaggtgctcatgggtgggtggagaggctgcgtgggaggaggtgctcatgggtgggtggagaggctgcgtgggaggaggtgctcatgggtgggtggagaggctgcgtgggaggaggtgctcataggtgggtggagaggctacgtgggaggaggtgcccagagatgggtggagaaactgtgtaggaggaggtcctagttgtctgcatttcctttgggagaacagccttagggaaaggaaagagactggtggagcaaaatccgagaggctgaggcagcataaaagtctctcctccatggaaaaacttggagccaaaagcgcacattcctcagtgaaagacgccaacctgaaaggctacactttgtatgattccaactatgtgacattcaggaaaaggcagacttatgggggccttaagcagatctgtgcttgccagggtttggtggggtgggaaggatgaatcggccgagcacacagaggtttggagacccaaaagacgtctgtatgatcctgcaatggcaggtgcaagacggatggatttgtcacaactcacagaacacacaggcaaagggtgaaccctaatgtcagctgtgggacttagttaataatgtttcaatattggtttatcaattataccacatgcaccacactaatgcaagatgtttgtaatttggaaaactgagggcaggggaagaaggaggatatgggaactctctgtagttctgttcagtttttctctaaacatgaaactgctctaaaaatataaagcttattaattaaaaatagtaataaataagaaaagtttaccaggaaggtaaatggaaagtatttgatagttctaggatggaacaaaaaaggaggtacaggaggaagtgctggccgagacggaaaggggatgcctggtcattggagactgagaggagggaggagcaccaggtacttcagtgtgtccgggaggaagccttctgcagggaagcagggaccctgggccaagctggagcctcccagaggcaaaggctgagagtgaggctgatggagagggaagccctgtaggcaaaagggagagggagtgggtgtgggagggagagccttcagtgctcctctgtctgccccacacctccttgtccctttagagtaagggggcagtaggtacaagagagatgtaaggagagcaggaaagattggaattggcattgaggacagacgtgtctcacactctgggtggttgtgatgatgggaatggttagtggtcagctgaggttggagacattgcatttgtcattcccaaaggtcattctcaaaggtcaaggtgttgatgtggaggaggtagattcggcataaaaccaagttgggcattcgctagtctgggcagagaaggagttgtgtgaggaaagccattcagtaggggattggagcagaggatgaatgaccaccaagtggctcatccaaaagggaattcccacagtggagaagaagttggaaaagtcactctcaaatcctcttttaacttgaaaggaaaagaatctgataccctgcaagaaatcaaattccaatgcaaaaatataggttcctttcataggaacagatgtggagaatatgattgaggattgagaccctaaacccagtttcccacctgacacagggattgagcccatttgtttttgctacagagttccatagagtaaacttgtcccaatatctgacatattactgggcctttaaaagaaattacatatagatagttgttgtaataacattttatcaatattcaaccattgatccttcctaattaagtgaagggttaagggaacacacatatacatctacacattcacatatatacgttgtgtgtattatattgcatggtcaaattatttaccagtttatcaatgaataaaccagcatttatggaatatctgctaggaagctctgtgctatctattttcacatacaatagattattgcgtccaaccctacgaggcaaacatgattattttcattttatacacaggaaacaaacttggatccagttactctattgcctcaagccctttgcttctagtggcagagttcagaattaaatttacaccttcttggaattatctccaccacttcacaacttcctccccacgaggaacatcctggtgtttttgaagacagattgccacgactcacttctggcatcttggagtcacttgtttaacttatagagactgagaaagattgagaggttgagagagtcactagctagcaaaaagaaaacaattacctctttggactatggtagagtttataaattaatagccattgtttctcttgattttcatgaccattctgtaggacgagggtagctattgtccccataggagaaaataagacgcagagagttgctgaaggccgtgtgatccacacgtcataaggttgggactaggatgcaaacttttgattcctggtgtggatctatggaaactcctgtaacgtgttggtggtgagggaagggaaatgcatcttagcttatggaagaagtaaaggactccttgagcacaggtgagccaggtaataaaagtggaattagtgaatcaccatcgcatattggccctagtgttcatgcagtgatggtgaatcaccatggcatattggccgtagtgttcatatagtcatggtgaatcacgatggcgtattggccgtagtgttcacgcagtcatggtgaatcaccatggcgtattggccgtagtgttcacgcagtcatggtgaatcaccatggcgtattggccgtagtgttcatatagtcatggtgaatcaccatggcgtattggccgtagtgttcatatagtcatggtgaatcaccatggcgtattggccctagtgttcatgcagtcatgatgaatcaccatggcatattggccgtagtgttcatatagtcatggtgaatcaccatggcatattggcgctagtgttcatatagtcatggtgaatcaccatggcgtatcggccgtagtgttcatatagtcatggtgaatcaccatggcatattggccgtagtgttcatatactcatggtgaatcaccatggcgtattggccgtagtattcatatagtcatggtgaatcaccatggcatattggcgctagtattcatatagtcatggtgaatcaccatggcgtattggccgtagtgttcctatagtcatggtgaatcaccatggcgtattggcgctagtattcatatagtcatggtgaatcaccatggcgtattggccgtagtgttcatatagtcatggtgaatcaccatggcgtattggcgctagtattcatatagtcatggtgaatcaccatggcgtattggccgtagtattcatatagtcatggtgaatcaccatggcatattggcgctagtattcatatagtcatggtgaatcaccatggcatattggcgctagtattcatatagtcatggtgaatcaccatggcgtattggccgtagtgttcatatagtcatggtgaatcaccatggcgtattggcgctagtattcatatagtcatggtgaatcaccatggcgtattggccgtagtgttcatatagtcatggtgaatcaccatggcgtattggcgctagtattcatatagtcatggtgaatcaccatggcgtattggccgtagtgttcatatagtcatggtgaatcaccatggcgtattggcgctagtattcatatagtcatggtgaatcaccatggcgtattggccgtagtgttcatatagtcatggtgaatcaccatggcgtattggcgctagtattcatatagtcatggtgaatcaccatggcgtattggccgtagtgttcatatagtcatggtgaatcaccatggcgtattggcgctagtattcatatagtcatggtgaatcaccatggcgtattggccgtagtgttcatatagtcatggtgaatcaccatggcgtattggcgctagtattcatatagtcatggtgaatcaccatggcgtattggccgtagtgttcatatagtcatggtgaatcaccatggcgtattggccgtagtattcatatagtcatggtgaatcaccatggcatattggcgctagtattcatatagtcatggtgaatcaccatggcatattggccgtagtgttcatatagtcatggtgaatcaccatggcgtgttggccctagtgttcacgcagtcatggtgaatcaccatggcgtgttggccctagtgttcacgcagtcatggtgaatcaccatggcatattggccatagtgttcatatagtcatggtgaatcaccatggcatattggccgtagtgttcacgcagtcatggtgaatcaccatggcgtattggcggtagtgttcatatagtcatggtgaatcagcatggtgtattggcgctagtgttcatatagtcatggtgaatcaccatggcatattggccatagtgttcatatagtcatggtgaatcaccatggcgtattggccatagtgttcatagagtcatggtgaatcaccatggcatattggcgctagtattcatatagtcatggtgaatcaccatggcatattggccgtagtgttcatatagtcatggtgaatcactgtggcatattggccgtagcgttcacgcagtcatggtgaatcaccatggcgtattagccatagtgttcatatagtcatggtgaatcagcatggcatattggcgctagtgttcatatagtcatggtgaatcaccatggcatattggccctagtgttcacgcagtcatggtgaatcaccatggcgtattggccctagtgttcatatagtcatgtgaatcaccatggcgtatcggctgtagtgttcatatagtcatggtgaatcaccatggcgtatcagccgtagtgttcatatagtcatggtgaatcaccatggcgtatcggccgtagtgttcatatagtcatggtgaatcaccatggcgtatcagccgtagtgttcatatagtcatggtgaatcaccatggcgtatcggccgtagtgttcatatagtcatggtgaatcaccatggcgtatcggccatagtgttcatatagtcatggtgaatcaccatggcgtattgggcgtagtgttcatatagtcatggtgaatcaccatggcatattggccgtagtgttcatatagtcatggtgaatcaccatggcgtattggccatagtgttcatgtagtcaagatgaatcaccatggtgtattggcgctagtattcatataatcatgatgaatcaccatagcgtattggccatagtgttcatatagtcatggtgaatcaccatggcatattcgccgtagtgttcatatagtcatggtgaatcaccatggcgtatcggccgtagtgttcatatagtcatggtgaatcaccatggtgtgttggccctagtgttcacgcagtcatggtgaatcaccatggcgtgttggccctagtgttcacgcagtcatggtgaatcaccatggtatattggccatagcgttcatatagtcatggtgaatcaccatggcatattggccgtagtgttcacgcagtcatggtgaatcaccatggcgtattggcggtagtgttcatatagtcatggtgaatcagcatggtgtattggcgcttgtgttcatatagtcatggtgaatcaccatggcgtattggccgtagtgttcatatagtcatggtgaatcaccatggcgtattggccatagtgttcatagagtcatggtgaatcaccatggcgtattggccatagtgttcatgtagtcaagatgaatcaccatggcgtattggcgctagtattcatatagtcatgatgaatcaccatagcgtattggccatagtgttcatatagtcatggtgaatcaccatggcatattctccgtagtgttcatatagtcatggtgaatcaccatggcgtatcggccgtagtgttcatatagtcatggtgaatcaccatggtgtgttggccctagtgttcacgcagtcatggtgaatcaccatggcgtgttggccctagtgttcacgcagtcatggtgaatcaccatggcatattggccatagcgttcatatagtcatggtgaatcaccatggcatatcggccgtagtgttcatatagtcatggtgaatcaccatggcgtatcggccgtagtgttcatatagtcatggtgaatcaccatggcgtatcggccatagtgttcatatagtcatggtgaatcaccatggcgtattgggcgtagtattcatatagtcatggtgaatcaccatggcgtattggccgtagtgttcatatagtcatggtgaatcaccatggcgtattggccatagtgttcatgtagtcaagatgaatcaccatggcgtattggcgctagtattcatatagtcatgatgaatcaccatagcgtattggccatagtgttcatatagtcatggtgaatcaccatggcatatcggccgtagtgttcatatagtcatggtgaatcaccatggcgtatcggccgtagtgttcatatagtcatggtgaatcaccatggcgtattggccgtagtgttcatatagtcatggtgaatcactatggcatattggcgctagtgttcataaagtcattgtgaatcaccatggcttgttggccctagtgttcacgcgatcatggtgaatcaccatggcgtattggccctagtgttcatgcagtcttgcaaggcactgcatattatttccagttagcatttatgggaatttacatttgtcgtatcaaagaaaagttaatcccctgctgtttctgaatatcttagatacctactgaaaatcataatctaacaaactgaatttcaatattaagtaaggcaatggagtttaagtctttctgatgtcccactctgccctctgtgcttagaaaattccaaataaacacaggtcaagtgaatttgttaggcttgtctctaaactttcaaaaggatctttgctgagagccacctctcgaacctacctttatttactaatttatttgtttgttcataggcacataatgagggcctgtgctgtgctccatatggaattctttttttttttttttcagtttttaaaatcaagatcacagtatgttgggagggcaattatctgacttttcattcctatttaggataatttttaaagccaatgagatataagctatgaaattctttttaaaaactttttattttgaataattgtagacacagaaaagttgcaaaagtagtgcaaaaaaatctcccatatttctcatgtcaccactcctagtgatagcatattgtataactttggtataatgatcaagaataggaaattaacatgggtgccatattgttaactcatctacaggcctcatttgaattctaccaatttttctaccaattttctacctgtgtcccaggaccccatgctgcctttagatgttctttcttcttagcaccctccagtctataacatttcctccatttctccttgtctttcatgaccttgcacttttgaggaggactggtcagttatgttgtagtgtccctcaatttgggtttttcccagtgttttctcatgattggagtaaggttctgcattttgggtaaaaaatatcacataaatgattatttgtccttcccattgcattatatccaatgggctccagtgatgttggccttggtcatttgcttaagtggctgtctgccaggtttccactgtaaatttgatgatttgatttatttaattatttatatcagtaaagactcatgggtatttattttattctatgggttaatccagtactaacattaatttttgttgttgttgatcaaactgttctagtatgagtcattagaaactcctttaggttagctttcatgttctctcaataaacccctatttttttagtattccattgctttctggtttcctaaaatattcctgactcattctgtattttccctgccccagcccagatacaattgctcctcccagaagccctattttcttttactgggtgatggtatttagacaccaagatctgggtgctaactgtgctcattgctactggggtgtcattgtttctaggccttctcagtggacagacgcaggacatatttgtatgtatactaacccatggacacacacatatctatattttggatctatctgtgtacatagagattaaaaaccatgagtttatacagatacctctgatttcaaacttcacagtttattttagtgttccccttttccttataacgttttttttcaacagtgaaaaacctggctttcattatctccaatatatttacatatttgtcccattctagcatgcacacagtctcaaaattgatcctccaaacccctgggagaaacaaatttactcacggaactacagagaatcttccttctctcagcagtcccatctttccaccctatttccacctataccctataggtaatcaatctggttcctggtttctgcttcctacatttcctttttcacaaaagactcgattcatatatattctcatatccctttcttctatgatatataattatatcatactatatacatacatatatgtgtgtatatatatatatatatacacatatacatacatacatacatacatacatactataacacatactcttgggctttgttaactctgacatggaaatcactccatatctgtttatagagttattcattctctcttacacctgcaccctacttcattgtattgggggggtatagttttggggggttttataaattgacaaatgataattatatatatttacagggtacaatatgatattttgttatatgtatacattatgaaattattaaatcaagctaattaacatctctatcacctcatatacttatcttttttcattgtggtataatagttaacatctattctcttatctattttgaaacatgcattacattcttattaactataatcaccatactctgcaacagatctcaaaaacttattcctcctgtctaactgaaactttgtatctttttatcagcacccccccaatccctcccactcccagcctctggtaaccactactactctactcactgctcaatactattcagccttaaaaaagaaggatgtaccgtcatttattcaaccacatattgtttccaatatttgcaactacaaataaaactgcaataaatacaaacttgtgcacatgtatttgtgcattgtttgaggtgaattctctaggagtctagaagtggaagtgttgggctgaaagttaagtgtgtactttattaggtattgtcagatgtctctctgaaatgattgcaccagcttgcttcccgacaagcaagtctgagagtgcctgtttccctacagtctccccagcaccatgtgtcatacttttttcttctttttccaagtctcataggtgagaaatgatatctcaattaattttaattcctacttccttaatttcatatgtatttgagtacctttcatatgtttgattgagggccatttttatgtctttttgtgaattgtctgttcatgtctttttctcatatttttatcttttttttttataaccacatttttcaaagtattttgtatgttagggatattagccatgtgttgtaaatacttttctcctggtttgtaagatgtcttttgtttatgatgcatctgtcatgcaaaagttttatgtttttatgtagtccaacttattaatcttaatttctggctcctgaattttgagtcatcaaagcttttctctacaccagggttcaagaggaattaacctatgcttatgagaatactttgaaacatcataacatacaaatgttggctgggcacagtggctcacgcctgtaattccagcactttgggaggccgaggcagacggattccctgaggtcaggagttccagcctggctaacatggtgaaactctgtctctactaaaaatacaaaaattcgccaggcgtcgtggcaggtgcctataatcccagctacttgggaggctgaggcaggagaatcacttgaacctaggaagcagaggttgcagtgagctgaggtctgccactgcactccagcctgagcgatagagcaagactccttctcaaaacaaaacaaaacaaaaccacgcaatgttaaaaactcatctattaacagaacctgcaatattaggactcgcttgcatcttccgatcactgggcagctgccttcccagctggtttctaagcggcaatgtcttctctgaattggcatcgtcactctaccctcaggcttcctggcttctccaaacccagacacttcatctaaaactacctggggcattctagactctctagcctcccccatctgtctttactctaaatgtagtccttgtttttcctggtagttttattcagccgttgcttttgtattttctattgattccagtccaccatgtccttagccccttcaccttccttcccttcctgcctcatctcctttgttcatgcaacccctgaagtgcagcatcctccctttccaaaggccattcaaccatttctttctacagatgagtgggtgcattcccagctatgtgtatattttatatatatatatatatatataatatacacatttttttttcaagacagagtttcgctctgtcacccaggctacagtgtagtggcatgatctccgctcactgcaagctctgcctcccgggttcacgccattctcctgcctcagcctcccaagtagctgggactacaggcacccgccaccgcgcccgactaattttttatatttttagtagggatggggtttcaccgtgttagccaggatggtctcgatctcctgacctcgtgatcgaccgcctcagcctcccaaagtgctgggattacaagcgtgagccaccgcgctcagccccacataagaaattatagctaagtgatagggcgcttacctgacagagcccagcagactcagcagaacacagatatcattcttcacgtggaggggtgtcatccaaaagaaacatgaaaatgaatcttttctacacgttggagacagcagtagctacaaaatatactgaaatatttaatacttataaaatgttagcacttttcatttttcccaccatgacctttactcactataacctttaagtacttagagaggtttttgttgtggtggtattggtatttaatcagtacattaaggataaaaaatataaggaggtttgaaaggaaatacatctttcaatttatccccttcctccctctctctctcgacttgtatctgtcaacacaaaccaacacaaaacctgatgccaccaggtttgtaaggtcataatgacctgcgttatacctagaaaaaattatcttctaggagaaccaaagatggagatacaaattgtggaggtagatcactgcatggttctgcattttaatttttaactttgactgttctggagatttaagaagttgatccaaagacctcactgcatgtcctctcttaatgagtatttactatttgggttaagcaatgatggacctatttcagcttcatataaattatatacatctgaagaaacctaatagagactaaatgagacatattacttagtaacacaagagacaagctcttgaaatggataccatggaaggagaaaggagttaagttataggtaggggataaaattgcagcagcttaaattcttggttcccaacattttgctttgtttttgtttgtttgttcaattttcagggatcctcaaagtctggacccaccagaagtcagcaatgcaaaacttcagtatgcaggatggggccctaaaggccaacagctggtaagccaatcaagttcagtaactatacttgggttttgaggaagtttctgttttctaagctgaatggatctcactgtactcagcctgtacatggtgttgtgtgtgtgtgtgtgtgtgtgtgtgtgtaaattaaaatctggagaggtacaccagggtgtctgaatatgtaaaagggtcatttctttttagatagcaaattctcctaaaattggaacagcatgtgcttggttcctacatctgacatggttaaagtggtgcctaactgtagctgtgtctatggactccagatgaatcatgagctcaaagagatcaacttcattaaaagaactgcagatgagaatgatccgaatgattttgtcatctaaagatgctctgggaactcagacttcttcctgtggagggtttttttttgttttttgtttgtttgtttcttttgagatggagttttgctctcgttgcccaggctggggtgcagtggcacgatctcagctcactgcaacctccacctcctgtgttcaagcgattctcctgcctcagcctccccagtagctgggatcacaggcgtactccaccacacccgactaatttttgtatatttagtagagacagggtttcactatgttggccaggctggtctcaaactcctgacctcaggcaatccacccgcctcagcctcccaaagtgctggcattacaggcgtgagctaccgtgcccagcctctgcggagggttttttaagcaagtagatttgctggccctgatggagccaggccagtcccgtcaacatgcaaaaccccccgtggtcattgcagccttctcggtttctatcagctatcttcatggattccttctcaaattggcaaaactgctgggtttctgtgaatgggaaggacagtgcagagaaaaaggccctgaacactatttctaagatgagggctcccaccctggttctcactgccgagctggccttggacagcacctcccgctgtcaggctgtaggcagcagcccagccatgtagtgaagaatttggataatacggtccttcaggtttgttccaactctagccttgcgtttgactaaaacttggttatatttgtccattctgggtaacatttttttaagacattgtattgccacgtgcagaaagtccctcaggtttgaaggtcagatgacatggttgctgttttcaagtcaccattttcttctgcctctttaagctgattacctaagcctgcatttgtaaagctcctttttcctaaaatagcacaaaaaatgatcgtatctaaaagctcccacagaattgtatcggataggctgtcatctatcttacaaatgaaaatagtcttatttctccccatagtacaatcacattttcttggttatatattaattccactgccttgaattggtttgaaaaagcaagaagatcgaggcggtgaaactattaatattttagctattattaacatgtctctaatgctaaaactgataacagaggttttgaaaagcatatgtaactgatcaaaatcacagggtgacaggaggaagtgaggcagctgagagctgaccttgaccgaggaacaccaatccatcagttcagtcacaacaaagagacaaaatttgtcttttctcaaaggcattaactcttacacagggaaaaaaatgcaatttgataagagattgtagaagatctaagttttcaggactgatgcgcaactgaatctctaatagttgactttaaaaccctctgaaagtctgtgattgaagagattttcaatatccatcaaatcatctgtgaaagtggccattacacctccatagagagctctccctgcctgctgcggatccattacaagccagtacccacagctctgcacctggcctcatcaccccactacagggagaaggatgggaatgtgtaaccttactgagtgatcattgtccagcctttttatagtagtcaggagaagaccatcataatgtgaccacatgtcaaggtctctttccaccatacctgcggcctcgcttcttatcacccagcggctgtaactcagtgtgtggactcctgcctcattgtctgcacatgcaaataaaccgggtcccgtagtagagttggtacttgtcctgcctctgggaacagcttgtaacataaaggaaatttaacccacaactgtaaaaggagttgctgtgcatgcatatgtgtgtgtgtgtgcgtgtgcatgcacacactttagaattaagtctataattgtcctcttgaacaactgaccttcactcatgtcatgctccgttggagatgaggaggggataagtgattatagaagttatcttgtttaacctcttacagaataagtagcaacaaaacaaagtaaatgacaacttctcagagaaggcttcctgacacctcccccaacacacacatgcacacacacacacacacacacacaatggtagctagccatcctggggcttcaggtttcaccgtgcaatctcccagcacacatgatctcttgttgcctgtagacatgtctctctccttggttaggtggtgatatggtgtggctctgtgtccccacacaaatctcacctttgaattattataatccccatgtgtcaatggtgggaccagatggagataattgaatcatgggggcagtttcccccatgctcttctagtgatagtgagttctcacgagatctgatggtttccccctttgctcgacactcactctgtcttctgctgccctgtgaagaggtgccttctgccgtgattgtaagtctcctgaggcctccccagcaatgcagaactgtgagtcaattaaacctctttcttgtataaatgactcagtctcaaatatttcttcatagcagcatgagaacaaactaatacaggtaccctgagtccacacagtgagactgtttcatcttcgtattctaacacacccagcacagtgtctggtgcccagtacacatttgttgaggtaaaagatgaaagcacaaacagattgattaattcattagttaatacatttttgtggtttcaaaccacttcagcatgaagaattggatggtggcaaatagccagcatctatgaatatgttctaggacagtactagaggtgacagaaatttgacttcctttctgcttcaaagaaatgaatgttcaggtaagtaataactgttaatacttgagtttagtaccaaaggtgctatatacttgtggaacttttgagtttttaaatccatttgacctttaagagcgttatgatacatgcatgtactgagcttaagacgcaatatagctcattgttgagtgagtaccctatgtgctggagcaggggccgccttcttctgcagaaggtcagatagcacatgtttcagtctttgcaaacagatagtttctagcacaatgactcatctcccttactgcagcatggaagcagctgcagacagtatagacaagatgggcatggctgtgttccaataaagctatacttcccaacacaggtggcttggcctatgggttatagtttgctgacccctgttttaggggatcatatgctgtcttggttgttctcatggggaaagcctgaccccagagccaccacctcatcacaggtactccccacacctgctccgtctgcacagaaaattcacaactcaagagcaggccttgcaagccctaacctattaagtgatgccaagcaacacacccctcattgccattttattttaaaaagtaaatattgctccctaaagtcaacctactctaattataatgagtcagattgaagtgagtaattctcctttgggagcagagaacacagctgcagttgaggtttgcaaagagctttgggaacatgtagcctcctgtgctgactgatttcagtgatgcctttgggtctggagcccctatatcacaggtgatgacccagggaaccagggatgggtgagggcatcttttcccagtgcctcgatgtggttgccaattagctcttaccttttagagtaagtgttgtgagacccatagaacatttctccggtagtaatgactgcagggggagtggcctgtgtgttgttagtggagtgggtgggaggaggcccccaggctgccagaagccacttctgtgatgatgctggtctggggctggagtttatgacaaatgacaagattgcttccaaacgtttgctgaggacccaggatgtgatctaggaaatagacttggccagattaaataggattaaatgagaaatcctaggtaaaatgttaacacagtgtctctcctttgcttcctcttcctccaaactggagtggtcagtcgggaaacataaacgttcaaaacatatgctgtttcaacgtatttctctgtaccacttctttcctcattgtgtcctcttcagatgaatctgcctgaactgagatttcctccatgtttctttcttttttttttttttaactggaatctccctctgtcacccaggccggagtgaatgttgcgatctctgctcactccaacctccacctcctgggttcaagcaattttcctgcctcagcctcccaagtagctgggactacaggtgtgtgccaccatacgtggctaatttttgtgtttttagcagagatggggtttcaccgttttggccaagctggtcttgaacccctgacctcaagtgatccacccacctcggcctcccaaagtgctgggattataagcatgagccactctgcccggccatccatgtttcttttctttgatcttttcatgaagtcctgcccccgaccatgtgtttgtctgtttatgggaggttttgtttctgctgacctagaatgtgattagttgtctggtttaggaatgtccacatatttcctgatatggtatttctattagagacatttcctggaagcacacagactttgaggcagccgcggtggccttccttgttcttggcacatgcacttggagttgaagctgcctcagggtgcatttgctggttgatctgcaaggggagggagggcatgtgaatttggtgcatcatcacgttttcctttggaaacaagtgccatggaaattttcccaagaaagactgtgcagcattaggcaacattaagaattcaaagccggaatctttgctggtacactcggaagatcagagacaaagtgaatgggtctctctttggttggcttgctaccatgatagtgataaatgaagagctttgaatgggaaatttaatgagtccattgggaagtcttcaacgcagagagcgtcaaaatgtgacagatgaagagcagtggagtagttagccgggaaacctgctggaactggggagagagctgtccccaagagatagcgttccccaaaggagcaggtgcaattacaaacaccatggagggaaactaaggaattctcacagccatgcttcacagcttagaaggaaaggccaacttcctcatcatctccagaccaagagaggctgaggggtggtgaatatcagtgagcaactgtcctgtgtcagtcaggagaaaaacatgtttatcaaaatgggagatttgagtcagactttaagaagaattgccttgattatatggcattttagatcctggaatagttttccacagaaggtcacagaatagtttatcggagaacgtcaataaatccgcatttaaattgtgctgtgttttactgcatgttctcactcataggtgggaattgaacaatgagaacacatggacacagggcagggaacgtccacaccggggcctgtccgggggcggggggctaggggagggatagcattaggagaaatacctaatgtaaatgacaggttgatgggtgcagcaagccaacatagcacatgtatacctatgtaacaaacctacacgttgtgaacatgtaccttagaacttaaagtataataaagaaaaaaagaaaaaaaattgtgctgtgttttaatggttaggatggcagctcccttggtgaagtcttaggagcaggtagactggactcccaaagatgttcccagccctagggctctctggaatggcacatgtggccagcgattgccatggtcacaagctagcttagtgcacgggaccctgcaggccggtcctgccgtgcatgtactttcctgtcattctcttatgcactcgtttgtttacggattcaatcaactcttcttgaatacttcctgtgttctggatactgcctgatcccggatgcagaagaaggacatggtccctttcctcactagcttctgcttctgatggcacattcacctattggcacattcactcgctctccccaaccgcgaatgctgcccgttgccctgctctggcacggtcactctcataactgtccccgtctgttcacactgcccaagctttcctctcctgtccacagcaggggctgtcacactatgtatttgatattcttctcatttttcaccaagatccttagatcctcaagtcttaacaaagtgatgcccctgaaaacaaagccatccagacaggcctcatcgcctaaggggtcattccgtacttgcttgatacagggcccatgaggccaatccagctctgagaaaaacttctctccaggggcggggacatggccatggggtgtgctgtctggaggtccagctgtccttacctcctacacaggtgttccgggctacagccttgcagcatgctgtctggaggtccagctgtcctaaccatgtgacctcctacacaggtgttccgggctacagccttgcagcgtgctgtctggaggtccagctgcccttccccatgtgacctgctacacaggtgttccgggctgcggccatggggcgtgctgtctggaggtccagctgcccttccccatgtgacctgctacacaggtgttccgggctgcggccatggggcgtgctgtctggaggtccagctggccttccccatgtgacctgctacacaggtgttccggctacagccttacagcatgctgtctggaggtccagctgcccttccccatgtgacctgctacacaggtgttccaggctgcggccatggggtgtgctgtctggaggtccagctgcccttccccatgtgacctgctacacaggcgttccctgactgactcacacagacactgtacccacaccctgcaccggccccaccttagtgattgctacaccctctcaagcctgtggcagttgtggctctctaagccacacctcagtgtgaagcgggatttaaggaaccagagagaccggatggagtgcaggagggtgtttattttaaggtgtacacaggcccagtggacatgtgtcctaaaggctgagcccagaacaaagaaaacgagtcccttttaagcattttgaggcaggaactacgtgaagcaggcttacagaagcgagaactaaaggctgctgtgacacttttgcaacatggcttacatctctgtgagaacttggtttgcggcttgtgcttatctgtcttgtgaccttgcagttgtggggggaagaaagaaacaggagtttacagagcctacaaaatatgtggaggatagatatggttattgtttcttgggacagacagttaatatactcttctaacttttaacttcagcggggctgcttaaattctcctcagccttggttaatacagaatttcattctatgagctattgttatttttcttactattattataatttttactattactacttatgctattattctgttgttttcttaatttcccacttcaagtggacggagcccattccaagcaaactattccaaggatagctgtttttcttcttaatacgccaacagcgagagagcgtgagccttcctttacctacccatgagcatctgccagtgatccagcgggcactgcttcctcccagaaccgtgtcttgacacttttttctatgaatcagtgaaagattcaagaaaattggagttgaggggttttttttgcactcgtgctgacttaccttatggcattggggtttttgccttcaataaaaataattttttaaagtagcccattaaaattgtaaaaatccatgccttcaaaatgtcagtaattcaacctaagatatggaggaagagcttgcgcttgaaactccaaaacgctttgttagagggacgaaagggcagtttgatagcagatcggagggatggagggcctttgcttcacccatcgctcacgtgtgggcgtctgcacggggaggagcgcgtggggagaaccatcagatttcagtgtgacagggaggccacgtgggtggcactgcagcagcagcacagagccagcgtgagggcaggctgggtgcagccaggagccagctgggagtgggaacccagccaggcctgggatgtggaagcccccactgagaaactcccttgtagggtcccaggccacctcctcagcctcagaatgggaaggtcctaggtaagaggtgaagccggctgggcttctgggtggggtgcggacttggagaacttttctgtctagctaaaggattgtaaaggcaccaatcagagctctgtctagctaaaggtttgtaaacgcagggatcagcactctgtaaaaacacaccaatcagagctcctgtctagctaaacgtttgtaaacgcactgatcagcactctgtaaatacgcaccaatcagtgctctgtgtctagctaaaggtttgtaaacacaccaatcagcactctgtaaaaacggaccaatcagcactctgtaaaatggaccaatcagcaggatgggggcgggccaaataaggaaataaaagctggccaccgccgcccaacagctgcaacccgcagctcgggttcccttccacgtggaagctgtgttctttccttcttcacaataaatcttgctgctgctcgctctctgggttcgcactacgtgtatgagctgtaacactcactgcaaaggtctgcagcttcacttctgaagtcagtgagaccacaaacccacagggaagaacaaacaactctgggcgcgccacctttaagagctgtgacactcactgcgaaggtctacggcttcactcctgaagtcaccaagaccacgaacccactggaaggaagaaactccagacacatctgaacatctgaaggaagaaattccggacacagcatcttcaataaccctaacactcaccgcgagggtctgcggcttcattcctgaagtcagcgagaccaagaacccaccagaaggaaccaattccggagaaacttgttttaagcgtgagaaggaaaagaatattttattttgtttgttttgctcttaaagggtcattagtaacaaaagctttggagtcaaaagggccagattcagatcgtggttgcagcacttactagttgcgtgaccttgactgagagacttaatccctgagcttccatctcttagtctgttaactgaagtaacagtgcctaccttgtagggctcatggtggagagtaaaataatctactcgaagtacaggctgtggagccttgtgtaaataacgttctcaataaatgtctttgattgttgctgcttttactatttgggttaatcgtctgagaatgagaaggaaaataagcatttcatcagatggaagtctggtgtgtgtcagaaggagagttgggctgcccttgataaagcagagaaacgcaggatagagacagaagctagggttggtgtccagagggcttcatgacgggccagcccccttgtccatcaccatccacagtgtacctgtgtggactcacaccttgctcttctcccactcttagggagggagggggaatgttcagaaaacaacatcaatttctacctcctgaagtcgtcagccccttgtaactattcaggagcctgtggctttagaaaaggccattgtcaggtgacagcaattcccctacgctaatgccacgccagaaattatcccttgaatggagagagtatgtttcttataagaagctgggtgtcctgcttcctgtatccagtccaggaagcctgcatccggtccgcagttccccattaccacctgggcaaccaccagggagctgagcagaaatgggcccgtcgcctcctcctacaagttacagcctggctcagggttagcgctgcccacccagtcccatggctgtagcaaagggggcagggagcactttactgaagtggacaaatccagcgaggggaggaagattgatctttccagcaagaggagagtctttaatgaaatgtcctatatgtggagaagaccagactaaagtgacatcccattaataacttataaaagcctctaatcagcttgggttaatttggtattcattgtaaaaacattcatcatgggcactgaggtctgtgacagtagccaagaaattaatatcccacggatggaaatggccttctgtaccctcagataatggatggagacagtttggtgagtgatttgttagcactaccaaagggacccttcaaatgtaacacaatatgttatcacttcctggctctgtggggctaaatcactttaatattcacttgcactcaagtaaataagctgagtttttggtaattaataggaatggatggggtcgtatgacagagatacctgatggtcatggttaaagagtgaggagaattaggaaataattatggggccctttcctgccaccaagaggctcttctcctgggatacagggatttcagaaaggaaatgcgtaatcataggattatgggggaagtgagagaagaaaaatataagtaggacatcaggaggaggtggagatttgttttaactctgtgtaaatggaggaggcataagagaaaatttatttataaaacaatatgaaaatatgcagaaagagtcatcaagacattcctatacaagatcacagaaatccctctaaaaagaagcccaaagctatatcaacaaacacattcataacactgttatccataacaggaatttctaaaagctggaaatgtcctaagtgttgagagctgagccatttgctaaatcatggagtatccataggaagaggtattatataaccatttaagattatgattaggaagactgcatgggagcatggagcatatatcatctatcaaacaatagcaggactaaaaataagccatttggtatgttggcatatggaaaggattagaaagtaatatattagtcaaaataattatttggactggccagactgggcttttttcccccttctaaaactttcttggttaaagcaacattatatatatattttttttaaaaaaaaattaaaaagagaagaaaatgtattgttaaaaatgggatttaggaactctactcaataaacatgtgctcaagtagtgttgagggtaaagaagaggcgctttttgcagagaatccaaacatgaataagccgcccatcaccctccggggatcacagtgccgttaattccaccggtttgaaagctctgttgcaaacccttcagagatattttctgggactcactctctttttgaaggagagaaagcagaataacaaaattcaaggtcacagattatgagtgtttaatatctaaaaattatttttaattgataagtcatcatcgtatacacttacgggatacaagaggactatagtcaataataatgtgttgtatatttcacaataagagaatacatttcaaaaaaaaaatggtaagtgagccttgagactcactcttaagccagaacaaaattaaggaaaaggtggatgcagggttaaaaccgggcctgacctgcttgcccacgttggccggtgaagataaaccctattttcttcctcatagcttccttaattcaattgcgactgaaacagtgtatcatttcttaggaataatcaaatttagaagggtgcccccacatcagcctcggcaatattaggttagagaatttcaagatcatttatcaaatagaatttaaagcaggaccagagttgtacattaaggaagagtgcacttagtgatagattcttgagagaatataacaaggcagttagttataaatgaacataaccttttgagacctttggatgatggggcgtggagccgcaccacacttgcggccatggcagatcctgtttctcgtcctgtggagggagcagcttctgaacatttggaggcttttccggtcgcctcgggtagggcgggggagggctgtactcggtgctgccaagaattctccttcgtgcacctaatcgggttctgtagattactttgtggaattctcccgtttgggtggagggaacacctcttcatcataattcctaaatgtttcaccattggaaaatatcaaagtaaaggttccatctcctggtctttgtagaataactgcgaccttttcttcctttaaagtgctgaaatactgtcagtcccacttactgtagcagttaatcttatgcctctttgttttattattcaactattttgcttttgaataactttatttcccagaccaaatgtaagctgttgaagaacaaagaatgtttttcattagacttttgtcttccacagcccgttgctcagcattgtgcagagtgtaggttctcaacaaatacttgtgaaatgaatgccatccagaagggaaagtaaaattaaatgtcagatttatagacataaggtccaacattcatggaaattggaaaactttgacgttataacctaaaatttttgagatttaacaacttgtctgatggcaaattaattcagcagttcagattcagttcagattgtgagcaataccaaggaagaaaatctggattttcgagtcagacatttgtcttaaaatgtttgttatgctgtgaaagatcttaaaaggaagatagagagtgctcctgattaaaacctgtcaggatcaggctgaactcaacaaggcgaaaggacctgaacttcttgtctttccaaggacgtttcagaggatgaaagcgcctcacttcttgtcccactaggacaccgaggtgatcgtctccgcagtgtcataaggaacagtgaggcctcgtgggcttgtgcccctcacgcactctccggtttgaaattggggtcggccctcattctaatgccctgtgagggcctcagaggttattgtctgggttgttaaacgtggagacagagagggcacagaacagaagataatttgctcacttaaaacaagaggtttctaagaacgtttggagaaattttagtgtgtccaagtcagttatttgtgaatgattcttctggacctttctgcaaagtagacttcacagggctcctcctttgcagaattttgttagccctgattgattattagaggttaattatcaatactggatactaacgtacttctgccctttgacgtgggtatttgcacagcccacgaggttttatttcacttctctgatgtgtggggaacacagtgccttactcgtgctagagcagtgatagacgtgagcacagataatcaatgagtcaatttcaatgacagaccactttggtttttttttagactgtgggttttacttttgttcttttgtttcatttttttgttgttgttttgttttgttttttgtgtaatagctcacatctagttcagctatttccactctaaaaaaagttagcaaattagtgaattgatttttctgtttgttcttcagtttgaaaacctcttcatttatctgaatggttttagttttccctttaatggcttttatggccaggaactgtttgaaatatgttttaatttcctccattaggccagatttaattaacgtacactatgcatgttggtgagctgagtgtgccgtctgacctccagcctagatcgctctagagcctgcgcctgtcccgtgagtgtgaggccaactgtgcactccagactcagttcattcataaatctaaactcactattgtttctgccaaagctctgccctgtaagtggtaccaccatctcttctgtgccaggtcagccaaattcttgactccccttcctcccccaccggcttgatccactatacattttatgaattctgctttcttggtatcatgaaaatccaccttcttctttctgttcccaccatcacctcatgcctaggttcctgtaacagctgccttcttggtttttctaccccaaaactacccctactccagaatgttctccatctctcactgagtgatctaaaatgcaaatataatcatgtccattttcccatgtaaaatccttccactgttttccactgcctttaggatagaacccaaaccccttcacatgctttgtgaagcccacctgaggtgccatcactcccctgacctctcctgccacccagtactcccaggctggagaccagccataatgagctacatccagttccgcaaatgtcccagaccacctctcactgcgaagactttgtatttgctattcacaaagtccagaacacactctttttttaaaaaatgttttaaaagaccatgtctagctctatcacccaggctggaatacagtggtgtgagcatggctcactgcagcctcaacctccttggctcaagcgatcctcccacctcagcctcctgagtagctgggacctcaggcacgtgccaccatgcctgtttagttcttgtattttttgtagagatgggggtctcactgtgttgcccaagctggtctggaactcctgcactaagcaatccttctacctcaacctcccaaagtgctgggattacaggcatgagccactgtgcccagcccaggacacactcttaatcccccacccctcacccctaactccaatccctgaagattgggcttgagacccctctgctctgtcccctgccactctgccattgccttatcaccacactcatcactctctgcttttgtgacctgtttccttgttattctcccccagccaaatccaagctccttaggaacaagcacctctcgtgttcactgctgtgtcctcagccactttgtgtagactgttagtaagcattaaatacgtgttcaaaggttgaatgggtgactcagtcaattaaggcatattatttacccaagatgaaaatcaattacttttttcaatttaagcgtaaactcgatttatgaatttttatgaaatttgtttctgtgttttcacctattggagatgttggctgacctttcatctctagccacaccctgtggcatcctcctttaaattttagccttttcagccaccacatgggtcccaattaccatgacaccgtgttcaaacccaggctcaccagtttctagttacccttcagataaaaaggttatgattgcacgtacatgtatctatttaattaagctagttttctccatggccatacaaagtcgtgtttctaaaattagctgggtgatctgactgtttagtggaacttgagtctttagaaggtcctcagataccactgctgtctacttcctgtaaatctaatcatcacaggacaaggtgcaggataggcttgcttagggaatgctgccttttaaatttcctatgttactgcatgacaagattagttgactctgataactccctacaaaagactcagaataataaaggaataaattaatcagtcaatggaaaagcaaacgatctataccaggctgatgaactataatagaacatctcattgttacacagagtcagccgtctcccactgccctgctgaatcctatctgaacagtaaatctgtgttgtaacagagccagcatggcaagcagctgctcagctggcctttcccctcctgtctcataaagaaaaatgccaatgtattcgtaatttcccagtgaggtggcagagtctgtaaatccttttttccaataaccctaaaattttactagccaacggttcaacagcctggtacacatttagggaaacaaaaggtttatggtggcagatgattgtttagaataatgtttcttaactcagctacacttcaacttgtgtaactacgaatgctgtggctgcatgcccagaggctctggttcgtttggaccagggtggggcctgggcgtcagggtatttgaaagctccccaggggcttctgatgtacaaccatgtctgagcatcctgggtttagatgcttacaggcgggactgggactggatgacctctttaataaactttgaagtttcaaggtcaacattccaacttcataataaaatatagaatctcttagattatatttttaatcaccaggcccatcacaagggaggtgctgaatataaaattgctggtcattaaaacattgccagggaaattgttgcttcaaaaaggcagctgtacttccttagatcaacatgcatggcttggccacgttgtagtttactttgctcctggtcaattcaacttaattcaactcaaagttaagatcaggatgtgataaaattattttgttttctttttctttgaatcctggatgagaagtcattgtccaaatcattaggtgttttatgcaatattaccaatctttagtgtgattttccccccatcaaacctataaacaataaacttttctaaaagaaagcctgccatgatggaagcactgggtttcagacagcaagtctcactgcatggctgtgcaggttgggacatactaacttgtgataacagcggccttttagatagggctcacaatgttcccaccaccatgctaggcactcagtgtattactgtctcttttgctcacaatatctctattcagcagtgagaaaatagaaattcagaaaatggaagtaattttccccgggtcacatatcagggatggtgtcagaactgaaactgaagaagtcgtgtcccagcttcttcctttggaccgaactcttaagtctggactctgttcagaatgacttctctcaagaccaaatgttctcaagtctatgagaagcctttgaacacctcttaaatgcactgtaaatacagtgttattaccatgaacgtgatatttgtatatttgtattcaaggccaccataaggatttttttttttttggcaatgcacagaagctggatgtctcccgatacagcatctggtgtaattaatccgacacccttatctctccccactgagcattctcaaagggaatgaaacattgacctaactgatatttccctctaaaatctttgcaggttccataaatgagctgtcagagccccagggcagacactgaaccccaactggaataaaacgttcctcctggagagggtgggtcagttatccagcacagcattcctcacatcccaggggtgtgcagagccctttcagagctggatcaaacaaatgaagcttgtatgtctccttttccagggggtgacctaagtatttgatgttagttttctacgcttcattattttttttatttcggatgcattttaaatgttaatgaaatattttatgaataaagagtaataaaatgagcactcacatgccctccagtcagcatgaaatacagagcattcccaagcatgcccagagctcggactccaggtccaccgggttccgggtccctcctccaccagaccaaccactcctctgaattttctttatgtttccctgccatttatggatctctaaacaatataccatttacattttgaacattatgtaactgttaccagacagtatctatactcatgtgacttgaggttacatcaacatagtatagatactgtctgtcttgtcactatacagtaacatgagtgtagacgcttgatgtaccctgagtgtacatactgtctggtaacagttacatcaagttatataaagtctcctatattatcttgtatgaacatgtggaagcattagctgtaattgagtctttttcagttttctgtcatagtccattatacaaatgtatcacaatgcctttatccagtcctttgtccatggatatttagttttctatttttaaatgtatttacagttttgctatgtgcattttgctcatgttttctggtgcacatgtggcaaagtttctgtaggttttgctgtgtgtatatttcattactgatggtgctgaacatctttgcatgggtgcattttctattcatgtcacaacttctgtaaaacacttgttcatgtcttttaacctatttttccttcgggttgtttgcccctttcttattgatgcgcatcatttctttatacatttaagattcaattatttgtcaattacattatttccaagatcttctctcattttacagcctgtcttttcactcttattttgatattctttggcaggaagatacattgatttcaatgcaatttattcctttatggtttgcatttttaagtcttcttgaagaaattgtccctaccccaaggacatagtctcgtagattatcttgtaacatttttttactttcatctttgacaattatgtctttagtccccctgaactggatttttgggaagggtgtgacgcatgcttacaattatctttccctaggaataatcaattgtcccagaacaatttattgagaaagtgttcctttccttactgatctttggagcctctgctatttatcaaacttctgtgtatgggtggatttgctttcagactctccactgtgttccactcatcttttgtccactgttgtaacaacaccacacgttcttactacagcttcaccacacagatggggcatttggtacagccagtcacctgggcatgctgctcctaagagtgtcctggctgtccttggccttttgcatatgtgtatatatgtgtcactcatgcacacacacaatttagaataagtttgttcagttcctctaaaaacactattgggagattagtgtgaactgcattaagtctatataccaatggagggagaatttataaacttcagctgttgaaactttcaatatgtggtatagttcccagtttatttacttaaaaaatactttctccataaatttttataattttctccaaaacagcttgcaaagctggtttaaatttactcttacatatcttctttggatatttttggtacatgtttcattttgtaaatgtaatttttagaatttatgtctgctagtgtattagtcagggttcagactaattagttagagggacagaactaacaggatatatatattaacttacacgatcacaaggtcccataataggctgcaagctgaggggcaagcagagccagtcccagtctcaaaactgaacaacttggagtctgatgttggagggcaggaagaggccagcactggagaaagatgtaagcttggaggtttggcccatctctctttttcatgtttttctgcctttttcatattctctggaagctgattagattgtgcccacccgattaagggtgcatctgccttccccagcccactgactcaaatgttaatctcttttggcaacacccacacagacacacccaagattaatactttgtatccctcaatccaatcaagttgacactcagtattaaccatcacagctggttaatagaattgcacttgacattttctattgattttgcatccagcagccttgctaaactcatttacttccaataattgatctgtggtttcttttggatcttgtatttagataattacaccctctccaaataatgacacatttatttcttcctttttcatcctcaactctgccttatttcctgatcttactccactctccagaaccacccacactatgttgagcagaacagcaatagtgaagatgcaaccctcgccttctagctcatcatagaggaaatgctcccaagtttttgccatggaatgtgaagttgctgtagattcatttgggaatgaccttggtcagtttcaggaaggccatttctatttctagtttgcacgatttatttgggaatgacctcggtcattgggttttgtttctttggttggttgttgttgttggtcttgtggtctgtgttctgtttgtctttattttgaatggattttgaattctatgaagtatgttttctgaatctattgaaatgatcatgtgggttttttttcctttaatctgtcagtgaggtgtattgtattgtcagtagaaaaccagccttatgtgactaggatagatgtgattgattgggatgtactttttaatatatacctagctagatttttttaacatattttctttaggatttttgcgtctgtgttcatgggtgaaattcgtctacactgtgggacattattgaatttaaaatcagtttattagaatggtaggtacttaagtaggtacaaacacaaaactatgcaactataaagccatatataatttaccaattcacttcaacaaatctacgaaagcaggaaatttaaaaacaattatatcaatttgcagtgctgatgttttactgaaagtctctggcagctggaatatgatgacaatgctgactgctccatgaattttcctttcttctcctgcattaccacgtgacttgtcatgacttaatttcccatgcattttctttatttgacctatagagaaaccttctttggaacaatacagccatgttattgttgctttgcttggcaggaatacatctttcgcatgtcaagtcccttttattcttttctcactggcccacaataactaaagcagtactacttggcaccagtgtgcttataaacataaattcaggccctaaaatcaggatagaaggacttgcttattggatagtcatccaggtggtccacaatatgggatatacattttactaagattctcatcaaaatgaacatatgaaatgtcagtgttttataaggacctgtgtcctcagattcccaggttgttatcactcagtttgagaagcatcccatccagagtttttacagaaggaattgttagtacagtttgctaggctgcatttgaaccaatgtcggccttcccttaggaccagcagagacggtaagcagaacttaggtgagtggtaaggagtcttttagagaagtcctcctccctcgagggcctcactcaagatctgactttgtagaaagcagaacttcacactgactttgagtaactgtcttccatgatgagctggggagagaatggaacggtgcccatgagactgtaggacttcatgaccttcagctgtttctccacacagagtgctctcagcctacagcgagagaggaatgatcccaccagctggaaatagagaggactgcaacccaaaccaccccccaccccgcatcatgaggcagcaagagttggacatatcttctccccatcttcccctggacacaccctacagaaagtcctgtggaaacaccccactatgaggctgccttattctcatgttagcctgatttgcaatagggaaaatgttgaggacacaaaaaaccctggctttatttgccctgatcacttcatcctcatggtggtaaaaatgccccatccatgcaacaagtcttcaagcacctctcatgtgccaagcagcccctgccttaggaccacccgctgttaagtgttcactggtgatgccactgtcttaccttatgagcactaaatgcttaagcagggctggtaaaacatagaacatttctcaggttattgtttcaaaatacactgtggttgtcaggcggaaaaggtttccctcttaggatcacctgtgacgagcaacgtcaaagtgttttggtgcaactcaaatgctttgctggaactgtttttctccatacaatgtacggggaaggcttccatgtcatggaacaaagtggtgaatgttcaaatggtcagggtgtgatttcatgggctgcatggattaaggaacattgaaacataaagttgaggacattgctctgttttcaattctctcaaacttctgttttccgatgaggagcatgattttgacacctcctaattcttgctcatgtctctttttaacaaatggagagtgagcctcaggcccagaactccaagcaggactgggcagaattcattatcatgttttggttttttggtatttattttatgcttatcattacttcactgcaaagaatactggtgttccatttatagtagtaatacaaaatgtccctgataaatgaaacttgtttacataaagagggaattgactgaaaagaaaataaagcagccgggcgcggtggctcactcctgtaatctcagcactttttgggaagccgaggcgggtggatcaggagttcaggagatcgagactatcctggataacatggtgaaaccccgtctctactaaaaatacaaaaaattagccaggcatggtggtgcacacctgtagtcccagctactcaggaagctgaggcaggagaatcgcttgtgcccgggaggtggaggtggcggtgagccaagacggtgccactgcactccagcctgggtgacagagtgagactctgtctcaaaaaaacaaataaataaataaatgaaagaaaaaaaggaaaagaaaagaaagcaaataatagtatcagaggtactcacaaaggtggttagtgtttaaccagccttgggaagtgctcctgtcagggaaggaagccagggtttagcaacaacacacgttgggtggaaacccagccctcactggattgatgatgtgtataacccctctgagcctcagtttccccattcatgaatagggcaaaaagacctcccagggatgctgtgaaggttaaaggcaataacttataggcagcattccttatgtggtaaatgttagttccctccctgatgttggaggagaaatctattattatcttgaatctgggccaaagacataataatatttgcataagtgatgaaagatgacaaaatggaaaaacatggacttgtagcaagacaagcctattagctttttcgaccttgaaacttctgatttgatttcctaatccataaaatgaggaagattaagatacttattttgcataattattgggcaaatctgaggtaatgtatgtaattaagtcacgtcctagtgatcacatcaagtacagagtaggcctcaatcaataacagctgtttgttatggtcctcactggggaaggaccatgactttccttcctcatgtgagaacctcctttatctttcaaattgtatcctcatgtgcataaaatattcttcagagtttgtagggaaatcgtttgattaatgttggggtcaagaagcaacaaggtgttgcggggacatcctctagagccttgagaatttggggtgtgaaattctaatttctgagatgctgatgtagctacagattctacatagagacccactcacctcattaattcaaggttcagggcactgaaagcgcatctacccatcatccttttctctttttcatacttttatttgaaaactattattctctctctcttttttttttttttttttgagacagggtctcactctgtcatccaggctggagtgcagtggcacagtcatagctcactgtagcctcaaactcctgacctcaacctcaagcaggtgttcctcccatctcagcctccctagtcactgggactaccggcacacaccactacacccggctaatttttaaattgtctgtagagatgaggttttgctatgttgcccaggcttgtctcaaactcctgggctcaagtaatcctcctgcctcagcctcccaaagtgctgggattacaggtgtgagccactgggcctggccctctttatttttctactgacaattaaccttctacttgaccagaggtctttttaaggattaaagagtggtaatttggctcccctaaaattcacagctgtgagtgtgctgtgagttgtgtgacagctgcattgcagttgcaattgtgtgctagtttctaacaaggggaagcaaacgctgacgtggccgagaaggaaggcccttactatgaggcttccgttaagtctcctccaggtcacattttcataacaccaagtgatatttttcagcttgaatgtctcctgatattataaggagtttgaaattttcctttattaattaacattttcattttgctcacattttggagagcactgattttccagaagtgctaattaccaagctcacagcagaaggttggctgcattttaaactatttcctcagatgctccctgctgaactcagagatgtcctcattcagccgagccagcctcccaggtgggtgggaggcccctggctggtgccactcacagactttgggcttcttctgaacccgcggagccctgaaacaccaataggcccacactcctgagggggttctggccacatctgcctttaggaaagatctgttcattggtgtaaaaccctgacgtgtgacatcagaaaaccagagcacctggccatgccccaaccctgtagctccaggcagacctccctatgatgtggcctgccatagtcatgtggctcgtgatgagtctagaaggcctggaagtttctgtctaagtctgggcaaaaacagagggactcacagcaccccttgtggtgtgagagtaatagatgcatgcatacatgtgtgaaggcttgtttgcagatgtctccatctgttatgtctgagcccattcaggctgctctaacaatatcgtagactggggtgcttagaaaaaacaaattgatttttcatcgtcctggaggctggaagtcaaggttaacttgctagctgattctgtgcctggtgagggcctgtgtcctggctcatagactgccttcttctgtgtcctcgcttggtggaagggacaagggacccctctgtgttgtcttttgtaagggcactaatctcattcgtgagcgttctcccctcatgacgtgatcatttcccaaagacctcacttcctaataccatcccattgggggtgggatttcaacattggaacttggggaggacacgaacattcaatgtgtaacaccataaagaagacatgggaggccaggctcagtggctcacaactgtaatcccagcactttgggaggccgaggtgggtggatcgcttgaggtcaggagttcaagaccagcctggccaacatggggaaaccccgtctccactaaaaatacaaaaattagccaggcatggtggcgggtgcctgtaatcccagctactgggaaggctgaggcaggagaatcgcttgaacccgggaggcagaggttgcagtgagctgagatcacgtcactgcactccagcctgggcaacaagagtgagactccatctcaaaaaaaaaaccagaaggcataggaatctggtatgtatgtactaatcttcaacattgacggtccccagcctttcaatccttgatgtaagtgatgaagatgagcttctgatctctcaaggcccggcggacccctttcctaaacctggggttaccattttcccatgcctgggggttttcccaggacattcatgctgataccaggacagtcccgggtaagcgggatggttgctcatgctgttgacaaggctctggggatcttggcgccaccaccttctcctcgtgccacacacacacatgcacacacaccacccatgccagacttctgaatctcatcttatgagtccattaattcactgttccccacctgctatatgtgcccaaagatttgagatttgcatagacaacattttgaaaagttttatcctctgttttgtcattaaaatagaccccgtgggtgggtcagcaagtgatattaggaagacgggggtgagatggtatcaaatgaagggaagactacagggctggcggcaaggacacagatttggggtagcagccagacttgggaatttggtgagggtgcatgacgcccaagactattgcagagcctgatgcctcggcccccgggtacctggaccacagtggcagggcgccagaaagggctgtgagggaactaggtcagcaaccaaaaactcacaggagtcaaacgaatactatgagccactatgtttgcccagagctgtgctagtgtgtgtatgagatttttaaaaagggaaaacgttactgttgcctgaaggagattaatatgtggataagacatacatacatgacagaaactaagaaagttattacaagattttaaccagagtcttaccaccctatttttaaggcaggagaattgtatgaaatgattgctatagttcagagaggtgaagtaatcctctaaatcacatagtgatttggtgttttgtgagtttggagaaggagaggtgaaggtggttctggaaggcttcctccaggagatggggcagactcgggctctgcagagcaggcaaggtcatcagagaagcggagcagcagagacctggaggcaggctgtgaggtggctggcgctgtgtggatcagggaggtgccgagggtaggagaatgctggcctggttctaagtcattggccctgcggcacgtggcctgtctggaaatgagttcctgcagacactctggacaggcaggagacctcaatgggcactggggcaacctgggccagctgtaggcttccttcctgatcaaacaagcggaccgtgctgagacacctccccgaaagccacaggtctcagccccttcatgggtgaccctgtgttatccacctgagaaagggcccaaaagaggcctctcagaggaggcaggccctgtggcagcacgggccttgaaatcggcccccggggcccctgtggcttcagtccagggactccatgccgggcgctgaaccacctccacaaaactcatgcgatcctcagagccccgcctcatcagccggaggacaggggtcacctgacagtgtgtctgaatgagcggaagcttccgttctgtgagagctctgggcttttgtgaactgacacggggcacagccacccgggcccctgggtgtggagtaacctaagaagtcgtgtacccctggggtgatgaggattgaggctaagatgggcagagggagaggaaaggttacacgggacccagtgacaggagtcgcagtgagttcagccctggtctgcccagagcagtccaagtttacccgggagtccaggggaagtcacaaatagagcttcctttcatgtgcaaatgtcccctcatttggatgataggttataggaccctcctaagtttggtgacttctgaggtctcaggctaagacatttctttgaccccactacagatgaagtacattgtttaagtgttggagggagtggcctagcccagggcccagagctggagcctgccagcctggtccccatccaggcccttccactcatgggctctgtcctgttgggcaaatcacctaggctgtctgtgcctcattttcctctaatatggatatcaacatagcgcccacctcatgggcttatgaggatgtgactcatactatgcgtgatgccgtgttagcctttgttaatgagaacctcctggtcagagctgtgctgtgggcagccaaaggccgattatggagaaccacccagagtggagttaggagccggcctcggggggccggtcacagagtggctcagctggtcagaaatcatgtctaagtctcacacaggcaggaaaatgcgacagtgagaaagggtcctgtcccagcccctgagagagtacgattctacaaagaccctgacacctgctcttgtgactgagttgcataaagtaggggttgaattcctgagtccactaaagacatgtacttccagaatggtaggagtgaaagaggggtgaacatagatggagaaccaagggttttcccaggtgctgtttgtaggtcacacaggggcacagtattgatgggaaagtcagcctcaggcatcatgtgcatcattcaaggtgtcccgtcatgttcctggcagagttggcttcatatccaacttgcctgactccacagcagcctccctttaaggaggcttggacaacccaggccgccatgaccggaaccccagaacctgcccacgagaagttgctcctgttctcctcctcccctgcgaggctcctctcaggccagggcttccaagtcccatgtaggcctccagagccaagacccctgcagcaccctgtgcactcaggcagaggaaagagcccaggatcctgcacagccccttggctctgctgtggcctctcatcgggccccttggcattccaggtggccctgccatcccacagacatcctccaggaagccaaggatgggaaggattctgaggtctgtttggcagaggtcacatggatacgttatgggagaggagtggtgttctggcaccccatggcttgaaggtttccattgttttctctgttgatataaagactggttttcagacagaggcaataagggaagaaacaataagtgagaaggtgaaagaggtcagtgttagacgtaaaaatgccacttcttctgcaaggttttcttgaactcccaggttcgaattcccaccaccttcagccatggcgtgcgcggctctgtctgtacactcagtgtacagtaaacatttgtctacaggtctttcccgtaacttgtgatatcccacacagcttaggatggtggcatatttattattttatcaccaattcccagtacaggtgctaggttcattttaggcatttggttgaactttatcatttatttattttcccattataaaaataatacagaatatagtaaaaaataggaaaaaaagcctttttaaaatagcatcaatagacccagtatctaaaattactattaatattttagtatgttttctaaatctatttccaagaatagatgtatttttttagttacaattattagttttacatcccaaccttttgatacaattagcattgtatacaattaaatacttattgttaacataattttcatagttacatagtatttcattgagtcgatctaccaaaatgcaattaaccattttccagctagaccagctggaccatgtataatattccctgttatcactgatgctgtgaagcacctttgggtctaagatgttccttgagtggaattactgagtcaaaaactaggaacacttttttatatacacttttgatgtatatttgcgaattgtcgtccgtatgcctcatcattcatcctgattccatgctcaccagcatcaggtgaatatgcaattcgttttaaagagaacttgctaaggctatgattttttaaaaagatctctgctaatataatttaattgcatagctatttaaatcagcatatatttaattatattctatagttaattaaattcacatatatttaatagtaaattgattttctgtaaagtaataccagtgatatctttcttgtgattttattcttgctccatttatcttttaatgtcttggtgtgtaaataaccaaaaagctccctgaaggggaaagacagcggaaatcggaaatcacctctgagtccttcacggtccagccaggagctagtctcaggcgtagcggagcccctgatgcccatgccagaggcagcgacttctgagctgggttctgtgattcccctgctcatcctctaggaggcactaatgagcagcagtgagctgaggaagacgaagagccagaggactccaaaacctggaagatctgagtaacctacagacgggataacgagcccctgtaggctgcagagaggttggctgctggtcacaccaccctggagaagagcacggttccaagatcagccacccagggaacctgggagggaagcagacactgtctgagaagggaggggattgatgacttcactgaaccctgaaactgatctcatctgctccaaatacctgggatgatccgggagacttagccaggaacatctgaatgatgtttcatgggtagcattttactcttgctagaagccggaggccactcgtattaggactgtatacaaaaaggcccagaaacttaacaagaaaaaaatagattttttcatcaccttagaaagatattgaaaattcattcacttctttgcagtcagagggtgacttctggcagctgacaagtctcggatctaactgcaatataaaaagatttgtggagtgagagagtgcctcccactgctttctaccagtcaataaatttgtcagtcctctgaaagctttcagagagaaaacgttcacaatatttgtgttttggttcagacctgctcctataaaggccccgtggcccagccttgttactttcagctgcaagaggcagcagctgagcccagtgcaggggctctgagtcacctggggaacttgccgcccccagacagccgggcccctgtgcagagtgtgtgactcagtatgtctggggtggggcctgagagtctgcatttctaacgaatccccaggtgctgctgagtggctgggcccagagtggccttggagaagccctggcatgattgcttgtgccatcaggctgcctagttctgccccttatgggcagggcgaccttgggtcagggctggcttctccaagcctgcatctcagttccataaagtcagaacagcaccttcctttcctaggtgttctgacgaggggagtcttcagagtgtgggctctggagtcggacagcctgggtccaaaccctggctcctcacctgaaaagggtgtcctcttgggccagtgggctccttcagcaccctaggtaacatagccctgaaatgaaaatcataatccataataatgcctatttcatagaattataatggggattaagtaaattaatattttaaagtcttcagtgtttggttaataacaagtactatgtgaatgtaaaataaaataaatatgtgcaacacatccatcaatgcatggcaccattacgagccctcaacaaagagtggttactatttttggattcattggtacatggttccattaatcaataaatatttagcgtcaagtttctacaaggttctggtgtaggcattgaaagaagcacaagatctggtttcccttgtcttaaagattataattttgtgggcagacaacataaaacagagttcagtaacaggagtttctggagagtgctaccagcacggttcacagagcagtgggccagtatcattttttgggagagatcctcaggcagtggagtgacaggagaaggtttcagaatgttcagactcaagttgggcctggagcattttaggctgaaaggactgagaagaatgatgcttcagggagtttgctgctgttgcacgtgattttcttgggctggttcagccttcttcaaaggccatgttccaaaatcagcttcagttctttaagtaaattctcaatgagatcgtttttgcatgagcatcaaaaactgttgacctagcgaagaaaatgtgcatctacttccccaggatagggcggtggcccctcgaaccccatcacacacacagacctcatctgtccaggtaaatgagattctcaatgagatcatttttgcatgagcatcaaaagctgttgacctagcgaagaaaatgtgcatctacttccccaggatagggcggtggcccctcgaaccccatcacacacacagacctcatctgtccaggtaaatgagatgcccagagaccttcccatcagacagaccacagtccagcccttgcccaagggctcagatatgacagcaaacacttaaccctccacccttgccatcaccatcactcatccccatcaccccccatctgcctggatttgtctccactcaccaaaatagcccagagatacggcaggctttttggaggatctggttgacccatttcctatgatcctccaggatcctcctggagttcccaggtgaaggtcaggccgcaagaattaacctgcactctagagtcgaggaaccagccagagctcttccagtcttcctgtcccgctttgcacgctcaccacagactgggctttccaggcctttctcctctgcctctcatcaacagcccccttgtgctgataaccacgcaggctgtggtccagtgctgtgcccaggtttggtcagctttgtttagatctaagcctataccttttttaaagtataacccaacgctacctagtttaatttgtccaaaatgccaagtgatttctccacgtgttttgattttgaaagctgaacatccttatccataggcattttaatttggagagttggagagtgtcatgagctttgtcatttgctagggtgagggtgatccaggctgagccgccaggctgagtgcactgtgaattagcgtggtgtgcggggagttactggagtagtccctgactgccatatcattgcttcactcaccagatcatgcatcttcccatcattgcttctgttgatttatcctcatttctatggctgccacctgtgaaaggttcataaatctccagactgcatcgggctctaccttcattgggccagaaaaaaattcaaacccacaaagttattccttggaaaatgtagaggtgagatctcctccagaaacaagcatgctgatagttgaatgtggcacatgagatgtcactcactatccatctgccatcaccttatacaaatgcaggcacgtctcatctcattgcacttcactgtattctgctttgcacatattgggttttttacaaattgaaggtttgtagcaaccctgctttgagcaggtctgttgggaccatttttccatcacatgttcactttgcatctctgtcacattttggcaattctcacaatattttgaactttttcattaccattatatctgttatggttatctgggattagtgatctttgatgttactgatgtaattgttttgggagccactaactgtgcctatataaggtggcaaacgtaataaacattgtgtgttctgactgctccacaaacaggccatttccctcacctcctcttgggcctccctattccttgacacacaatattgaattaggccaataatatcttataaaatggcctgtaagtgttcataaatggaagaattgcaggtctctcactttaaatcaaaagctagaaatgagtaagcttaatgaggaaggcatgtcaaaagcaccacgataggctgaaagccaggcctcttgtgccaaatagttagccaaattgtgaaggcaaaggaaaagtctttgaagaaaattaaaattgctgctccagtgaacatgtgaatgataggtaagggaaacagcctggttgctgatatggagaaaggtttcatgctctggataaaagatcaaaccagatacagtattccctgaagccaaagcctaatccagaacaagatcctaactctcttcaattctgtgaaggccaagggaggtaacgaggctatagaagaaaagttggaagctaacagagggtggttcatgaggcttaaggaaagaagtcgtctccataacataaaagtgcaaggtgaagcagcaagtgctgatggagaagctgcagtaagttattcagaagatccagctaagatcattgatgaagatggctacaccaaacaacagatttttagtgaagacaaaacagccttcttctggaagatgatgccatctaggactttcatagctagagaggaaaattcaatgcctggctttaaagcttcaaaggacaggctgactctcttcttaggggttgaagtagctggtgactttaagtcggagccagtgctcatttaccattctgaaaatcctagggcccttaagagtgatgttaagtctactccgcctatgctctgtaaatgcaataacaaggcctggattatagcacaactgtttataccattgtgtaatgaatattttaatcccactgttgagacctactgctcagaaagaaagatttcctttaagatattactgttcaatcccagtatgcctggtcacccaaggactctgaaggagatgcacaaggagataaatgttgtttctatgcctgcccacataacatccattttgcagcacatgaatcatggagtcatttagactttcaaatcttataatttaagaaatacatttcatggctggcatggcggctcatgcctgtaatcccagcactttgggaggccgaggcaggcagattacctggggtcaggagttcgagaccagcctggccaacatggcaaaaccccatctctactaaaaatacaaaaattagccaggcatgatggtgggtgcctgtaatcttagctactagggaggctgaggcaggagaatcacttgaacccaggaggcagagattgcattgagccaagatcatgccatggcactccagcctgagcaacagtgagacactctgtctcaaaaaaaaaaaaaaaaagaaaagaaatacatttcataggctgggcatggtggctcacgcctgtacttgcagcactttagaaggccaaagcgggcagatcatgaggtcaggaatcgacaccatcctggctaacaccgtgaaaccccgtctctactaaaaaatacaaaaaattagcagggcgtggtggtgggagcctgtagtcccacctactcagggggctgaggcaggagaatggcatgaacctgggaggcggagcttgcagtgagccaagatcgcgccactgcgctccagcctgggtgacagagcgagactctgtctcaaaaaaaaaaaaaagaaaaatacgtttcataaagctatagctgccatagatagtgattcctctgatggatctgggcaaagtacattgaaagccttctggaaaggatttatcatcccagatgccattaagaacattcatatgcattagaggaggccaaaatatcaacattaccaggagtttaaatgaagttgattctaaccctcataatctttgagagattcaagacttcagtggggaaagtcactgcagatgtgataaaaacagcaagataactagaattagaagtagagcctgaagatgtgactgagttgctacagtctcaggataaaacttgaatgggtgagaagttgcttctaggaacgagcaaagaaagtgtttcttgagatgaaatatactcctggtgaagatgctaagaatattgtggaaatgacaacagaggatttagaatattccataaacatagttgagaaagaagcagcagggtttgaaaggactgacttcaattttgaaggaaattctgatgtgggtaaaatgcaatcaaataggattgggtgctacaggaaagcttttgtgaaaggaagaatcaatcaatgtgcaaacttcattattgtcttattttaagaaattaccagttatcccaaccttcagcaaccagcccctgatcagtcagcagccatcaacatcaaggcaacaccacctgccagcaaaaagacgatgactcaccgaaggcttagatgattgttagcattttttagcaacaaaacatttttaataactcacatacatttttagacataatacttttgcacagttactaatctacagcagagtataaacataacttttatatgcagttggaaaccaaaagatttctgtgactccctttattgtgatattcactttattgtggtggttggtggtctgggactgaacctgccaaatctttgtggcatgcctgtatatggctttctgtttttatctttgagatagagtcttgctatattgtcgaggctgggtctcaaactcctcaagcaattattgtgcctcagcctccagagtagctgagattacaagcacacgccattgatgtgtatgtgtttaagcatggatgaaccagacaaggagctcctccagggcaaagaccatcattattcagaaacctggtacaaggaaaagctcagggagaggagagggggagaagggagggcatagaaaatattgtaactgtagccaaagaagtggatatatttgtcaggattttttagtgataaaagacaaaatgtcaagttaaactagactaaacaaaaaggggaatgtcttacttacctgggatgatcagaagtgggtttggcatccagggactcagacagcatcctggggcatgtctctgcctccatccttatctcctgctattttcctttcctgctttcccttttctgtagtctctcttcagctctacttctttctgcgtgttcatctcgctctcttccagtgcaaaacgtcttccatatggccaggaagacaaatcacccctgggaccctgaggtctgtatcattccagtgccaggacccagaggcaagaagcagtagactctgaagctccaggaaaggcatgagaatacctgacccacccagggtgtgtcagaggccatcactcagggcccatggctggggtggcagggatggaatcctgcagatttacatgcctgagtggtatgcccattgtgggggccagggctcccagacagcccctgagtcacaggcataggggagagatggcctcaaactaggcaaacaaaaagtggaggtcaccactacagcagttagccagaacatgtgaaagtaaaacataggcaaatactatcttaagtcattaatccagtgaatatgatcttctatttgttggtagaatagagcaactgtagctgagctagtgattacagcaacatctgatcaatgctttcaactcagacaaagtggccagtttcctgcgtagaagggttggaaggcctgtgaaggccactgttgttccccatctggcccatcctgcagatgtcccccctctactcggcccctatgcagcaatgagggcggtcatggaaaacaaaattctcaccttctcccttgtttggaatgtcctggaaccatgatgacaaccagcgcccttcagtgactcccattgttctcacacaaaagcatggagtcaggagtgtaacttctaggatcctgcgtcccctgccacttctccagcttatcctctcaccgcctgccttggcccagctgctgtggcctcctcccttcctcggaggattgtcctttcttgccttgcccagggcctcggtgaacgtggctccctctcctgcgatgctctcattccccttctttccctgggtagcctctgctcacccgtagatctcagctcagatatgattctcagggcagacctcacaaccacccagacaagaccctcagggtgccctgttggcactttttaaacttcctcccagcaattcccagactggagaatgtcaggatgcctggccaggccactcctagtcagcccctggaggctcagtgactccctgtgaggagggggagtttatgaaatgcacagccttgggcagggcctgatgctggttcctgtcactgttgtgcccacctctccatgtccctggactcattagaagggtgccatctcttcagtcagctaggaacttctggagctcctctgttacactaaatagcttcaagtggacactgaacacgtactatcaaatgcttaaaagcacaattttattttgagaactttttctcagctttggaaaaataatacctcagaattctccaggttaaaatgtgggttcaggaggtgagaaagatcccaagagatttctctgggtgggtgactctgaaaaggaaggttttcctttagcgtttgaaagctgcattgatgggaaggtctttagagtggtgttggggcttttcatcttgattttggttgatgttttgaaagaaggaatgatatgagtactttctggtaggaagagcaattttagattatctacaagcatttctctttcttggcactacactctgccctttggcattaaatcctgaagtaatttgctggagtggaaaatgatgtaatacattatactggtttttgaaggaaagggcagaggggaaaagtggtaaagtgagggaactacaagaatcctgtgattaaaatgcggtcctctgtggtaaggattggataggttgatgacacttattatgctaataatatgttacctttgaaagtgttttataacctccaggattttctcccataaattatctgctttcatcctccccacagcaccatgaggcaagcacggcaggtgtaattatctgtattttgtggataagaaaatcaaaatgcagagcagttaaatgattttttttgccatatcctagagctgcctaggcaagaaccaatgaaagaaccaagcattctggattttaggctgatgggttaatcatcagcctaaaatatgaaatactcactcagaataaacagttatagccattgcaaaaatgagatgagcccttgcatgccaactgctcagcacctcgccaggtccatcggacatgccccgagggtgtttgtggtgttgatgatgatgatgctgaactaaatgagaatcatcaggaatcttaaacctctcattgatcaacagctttgacatctcctctgtattagtctgttaccacgctgctaataaagagatacctgagactgggtaatttataaaggaaaaaaggtttgattgactcacagttcctcgtggctgaggagacctcacaatcatggcagaaggtaaaggagaaatgaaagcacgtcctacatagcagcagacaggagagaatgagacccgagcaaaaagggagaccccttataaaaccatcagatctcccaacatgtgggaattatgggaactacaattcaagatgagatttgggtagggacacagccaaaccatgtcatcctctatccatccgttacaagccagtataacaaaaggttgtgtatttgcccagctgagcagtgaaaagggaaaaggccaaaatatagggaatgtgagggcaaaatagagtcagtatttagtaactcacagattgaatgttgtgttcctgaaatagagcattgggtactctgagaatgactcctggcaattttaggactacttccatgggaaaaagcacataaccacgtgtatacatacatatgttattaaccttttagctcaaaggtaactgggctttccactaccatcagtttctgtatacaaggcttgaaggccaattatactttatttccagcagtctcttcatgtaatctctgcaagaaaagtctcttttgataggatttgccgactttttcttcagtgttcacctatgctcccgtcaggtgagcacactgcattcttagcagtgctgggtgtcattagtgttcagtctttcataatctgataaacaaaacattgtaataagatttctttttgttattttttagcaatttgtacagttctttgatcgatctgtttgtgtccttcatacacatatttatagctcagtgatcatgattcatgctttccacttgtcggaatttatcccagggaaatatcagagacacaggtgaaaatttttgtgccaagatgcacacaatagtattttattacgataaaaaaaccaaaagactgtatgtcaaataataagggattaattaaataaactgtcatatctcttcaagggcatgtctcaaagaatgtttaataacatggaaaagcatccaggtgtggtggctcatgcctgtaatcccagcactttaggaggcagagacagacggaatacctgaggtcaggagttcgagaccagcctggccaccatggtgaaaccctgtctctactaaaaatacaaaaatcagctgggcatggtggcacatgtctgtaatcccagctactcaggaggctgaggcaagagaattgcttgagcccaggagacagaggttgcagtgagccaagatcatgccactgcagtccagcctcaccgacagagcaagactctgtctcaaaaaataaataaaaataaaataacgttgaaaagcattcctaatataaattaaccattatattatatggccttagttttattaaaaaccagatttatacctctcctaccaacacacatacatcttgaaggaaatgaaatacaacaaagttgatttgtgtatgttttgtagagacaggatctcactctgtggtccaggcaggagttcactgcagtcttgacctgctggactcaagcaatcctcctgcttctgtgtctcaagtagctaggactacaggcgtgtgctatgacactcagctaattttttaatgttttgttgttgttgttgttgttgttgtcgttgctatttgtttttgtagagatggagtcttaccgtgttgcacaggctggtctcaaactcctggcctcaagtaatcctcccaccttggcctcccaaagtgctaggattacaggcaggagccaccatgctcagctcgaagtttattttaaggtggtattttgtatatgtgtgagtgtgatctgtaagacaacgacatttttcttttttttttttttcaaatattccacaaaaaacaaatacttgtagtcacagtttggtggcttttgctgtgctgttttccagcttgtaactggccagactgattctatgatctcaagccagcggttcacttttcaaaaaaacccaacactcctttacccagccccatctttgttgttggtatatctctctcgcttcttcttattactttgtagtaattttacttcagaaaagactcagaattcccaccatcatccagtttctgacatgaacccatggaaggcatactgttcaggaaggttggcctatgtcaggggcctgacacctgctttgaagcacccatcaggggccatgtgtggaccaagcatacattccggctctgcctgagtccacattcagcatcacctggactcagtaggatctggggcagcaacggtcagccagcagggtgacgtcacacatgtgcacctctcctgcagtattcaatgctgctgtccccccaaccacacaggagctgccttctcccccagcactgctgccagatgacagcttggtgcagggagcaggacatccacaagtgggtgtggaatcttccctgcccgatgcctctcaggagccaggggcatggcttcagggccccaccaggaatgtgcacgagggtcaccagactgggagaagtggcagctgtaactccctcccagtactcatggttctccttatctcaatgcaacttatcataaataatgctgtcatgaatagaggtaatattcaacccttatcaggtttccagggcaacaaaagcaggaagtcagctgatggtcaaattcgctgcaaagaggactcaccttaggttctgagtgccagagtgtttcttcaatctttcagacacagctggtaatcctaacttgctgttatatggcctattgatgaaaccactcgggaccacatgtggcatttgtagcacacccagaaattaaacccatgcagagaaacgagctcaccaggactccttaggttgtccttggagggcttcctcacctcacttgctagcagccactgcccaaggacctgctgtgttctctggtcagctttctgctttcagcagggtcttctaaaaggtacgtctacaaggttgcagatttggaggaagaattcctgtatcctggtgaagtgttttgtgtgtgtagagtgttccagtgacaggagttatttgcaggattggcacagtctccagtgaagactctcctgtgggcttcaggagcagtaacttgcgtatgatcattgctaaaccaatggggatagccagttccatggccagccaacctgttctgtgcttcgccctataaattatgttctatattacatacaacaggatctttcacttttatttactacagaaatgtcagtaaatggttcctgatgtaattagcttgatcaggaaatgtgataactcaagagaagccgtggaatagagagagaaatgcaattgccaaatagtcactactatgtggatatgtccttgacattaggaaagccgctataatgtgtcaattaaagaaacctaggcaatgtgataattgaagtttttaattgatatagagagagaatctatttcccccttaataataacatgttgggttcactatgaatgtttaatttcctttccatgataaatagttttccctagtctgggcatggtggcccacacatatgggaggccaaggcaggaggattgcttgaggccaggagtctgagaccagcctgggcaacagagcaagacccccatcttaatttaagaacaaataataaataaataaatagttctccttttcaacagaagtttggtaatataactaattaatttgctgaatatcttttactgatgtaaatatgaatgtaactattgaatttgacaaagtgaaaaatgaaagaaatctcttagagatcatccaacccaacctctaatgttatagtgaaggaaattgcattaaacagtgttgaataacctgctcacagctggacagctagtagtttcagactggaattcagggttccatttcaagtccaaggttctttcttttttatcatctcacccttagtagtattgctatcattttgtcaaatactgagctatgcaacatgtttcccttttggccttgattttccagaactaaaaaccaaatcgtgcctgattatagtaattattccatccctagttcctgatgtaattagccccctctttagctatttgtgtctcttttatcataaccattctgggaacatgcagattgtgcttttattgtaatttactttgaattggtttaagaaatattaagggtgtaaattgtcacttaatacacacacacacacacacacacacactcttcttctcagtaagttacctggaagttgtactaatcttttaatttctctttttaaattatcttagtgatgtaaatattcatgaaacttttggatttatttgacttttggaaaagtcaaataaagcctcaattagttaaaacccagccaactcacatgctaaaccttgggatagttttcctgtatacaacatacatggaaaagaatagcaataacacagataatatcaaggaaaacagtttctgggaatagatgtatatttgatctaatccatttttgtacatgcacaccaatagttttggacaatgaaaactgattatcttagtcaataataattccatattgtatacctcattctatctaataaatcaagaaagtataaagtctgaaaatatttccctaataaggactgaaattgaaaagatctcttctttagttagaaaattcaccaagaaagtgtatttaactgaaacttcccaatcctctagagaattccagtgtattagtccattctcatgctgctatgaagaaatacccaagactgggtaatttataaaggaaagaggtttaattgattcagttctgcatggctggggaggcctcaagaaacttacaatcatggcagaagacacctcttcacagggtggcagaagagagaatgaatgcccagcaaaggggaaagccccttagaaaaccatcagatctcatgagaaccagctcactatcagcataacaggataggggaaaacaccccatgattcaattatctctacctggtccgtctgaagacacatgggagttataggaactacagttcaggatgagatatgggtggggacacagccaaaccatatcattctgcctctggcccctcccaaatctcatgtcctcacaattcaaaacaaaatcatgcccttccaaaagtcccccaaagtcttcttccagcattaactcaaaagtccaagtccaaagtctcatctgagacaaggcaagtcccttttgcctatgagcctgtaaaatcaaaagcaagttagttacttcctagatacaatgggggtacaggcattgggtaaatatacccattccaaatggcagaaattggccaaaacaaagaggctgcaagccccatgcatgtccaaaatccaatagggcagtcattaaaccttaaagttccaaaaatgtgtttcacgtctaggtcatgctgatgcaacaagtgagcgcccatgggggcagctctgcccttgtggctttacagggtacagcctacctcccagctgctttcatgggctgacattgtctgtggcctttccaggtacctggggcaagctattggtggatctaccattctgggatctgaaggatggtggccctcttctcacagttccactatgcagtgccccactggggactctgtgtgggggctctgaccccacatttcccttctgcactgccctagtgaggttctccaggagggccccacctctgcagcaaacttctacctggacatcctggcatttccatacatcttctgaaatctaggtggaggttcccaaacctcaattcttgacttctatgcacctgcaggcccaacatcacatggaatttgccaagatttggggcttgcaccctctgaagcaatggcccaagctgtacgttggccccttttagcgatggctggagtggctgggacacagggcaccaagtcccaagtctgcacacagcagaggggccctgggtccaggccaggaaaactatttttccctcctaggtctccagacctgtgatgggaggggctgccatgaaggtctctgacatgccctggggacattttccctattgtcttggtgattaacattgggttccttgttacttatgcaaatttctgcagccaacttgaatttcttcccagaaagtgggattttcttttctatcgcatcatcagatggcaaattttctaaacttttattctctgcttcttcctgaacactttgttatttacaaatttcttcctctagatactttaaatcatttctctcaaatttgaagttccacagatctctggggcagaggcaaaatgccaccagtctttttgcatagcaagagtgatctttacttcagttcccaacaagttccttatcttcatctgagaccacctcagcctggacttcaatatcagcattttcatcaaagctattcgacaagtctctagtgagttccaaactttcccacatcttcctgtcttctgagccctctaatctgtaggaagttctaaactttcccacattttcctgtcttcttctgagcccttcaacccgttccaacctctgcctgttacccagttccaaagtagcttccacattttgggatatctttatagcagcacctcactctccgtagcaccaatttattgtattagtctgttctcacactgctatgaagaaatacctgagactgggtagtttataaaagaaggaggtttaattgactcacggttctgcatggctagggaggcctcaggaaacttacaatcatggtggaacctcttcgcagggcagcaggagagggaatgagtgcccagcaaagggaaaagccctttataaaaccatcaggtcttgtgagaactaactcactatcatgagaactggatgggggaaactgccccatgattcaattatctccacctggtccctcccaagacacatgagaattatgggagctacaattcaagatgagatttgggtggagacacagccaaaccatatcatccagttaattgaaccttcacagaatttactataaccttgagtgtataagccatatttatgctaaaatgttcatttttaaaaatgaaactaatgaaaatgtcatgtattttgtaaatacccagagggggcttgcccaaggtagactgagtgggcttacttgggaaataacaaagagatgagtctggcagaaagaaattgaggatgagaaataacttgggataggctagtgatggctttgaatcccaagcagaggccctcacacttttacctggtaggctcagaagaagaaggactaatatgataactattttattttattttatcttatcttattttattttattttattttttgagatggagtttcactcttgttgcccaggctggagtgccatggcacggtctcaactcactgcaacctctgcctcccaggttcaagtgaatctcctgccttagcctcccaagtaactgggattacaggcacctgccaccatacctggctaatttttgtattttttaagtagagatgggttttcacctggttggccaggctggtctcgaactcctaacatcagatgatccacctgcctaggcctcccaaagtgctgggattacaggcatgagccactgcacccagccaggataacattttataaaaaggaatatttgttgagctaatgtacattgaggcctactttaatttcaatatacttttcagacaaggaatcacacacttgtacaattttccgaccttatcattggaacacttgctaatatgatgcagatgaagtgggattgtgataggctattttaagtacttgaattatgagacaattttcgactgcagtagcccaaatggtaccctgcagccgtcaaatgtgaggaacttcagtgtgagtgctgacaccaaatggaacctcatccacccacctgatgaaaattgatgttcccctggctgtcaccctcagctgtacgctttgctcaagaagtactttgttttgagggactttatgttgtataaaatatggttttgcctgtcatccataggtgatgaacctgccatctctgtctcctgtctctctttaaacactaacttccagttgcctatggagcaactacctggaagtctcagaggcatctcacagtcaacctgcccaaactccactctgacttccttctccaaaccttctcttccttcttcatttcccatcttaattcttagtaacccgtacattctgtcacctaggtgtgaggatgagaaatcatatttatttccttctgttcccgccacacacccacaccctgtagattctgaatcctaatatttttcaaatccatcttcttttagatctcatttttgtagtttgtgctttcactatttcttaggcctccccacctccagacttctgcctcccatctcccctcagccgtcatggtgatatttctgaaatgaaaatctgattttctggctcttctatgactttgctttccaagtttacccatcacaaagaaaatgaagccccaacttccctggaacacaaggcttctcccacctggaacacaaggcttcccatagcctgacctgtcccccactcttgctgtgtcttttaccaccctgcatccctacccacttactattttacagctcttaccacctacttgtagtcccctaaatgcatcagatctgtgagcctttccacacatggatgctgacatctgaagagttctcccttcaactctctcccatgcacaccgaatgaattctccaggcccctcctctaaagcgttccttcttcacccccagctatagtttactgcccctttatattatatgctgctcctggatgtgggacagcaggtgcatgcctgatcaaatgtggtatctttaatgatcaacaaatgtcaggtaaacagatgcatgggttagttggttccagacatagaatttactcaaaaagagagcattttttttttctcctgaatggttttcaagatagctcaatatattatgccatttttaaaattttattttctttttagattacacataataattgtacttatttaatgtggtacagtgtgatttttgtttgtttgtttgttgttattgttgctgttttttgagacacagtcttgctctgttgcccaggctgcagtgcagttgtgggatctcagctcactgcaacctcagcctcccaggttcaagcgattctcctgcctcagcctcccaagtaactgggattacaggcgtgcaccacaacgcacagctaattttgtatttttagtagagacagagtttcttcatgttggtcaggctggtcttgaactcctgacctcgtgatctgcccacctcagcctcccaaagtgctgggattacaggtgtgagccaccacacccagataagtgtgatgtttcaatacatgtatacaatgtgtaattatcaaattacagtaattagcagattcatcagctcgaacatttatcatttatttgtggtaagaacacacaaaatcttctcttctagatattttgaatagacaatatattattgttaaccattattacccaactgtgtaatggaatactcggacttattccttctacctcattgtaacattgaccagtctctccccattacccacttgcacacaaacacacacacacacacacacgcacccttcccagcaccttcccagcaccgttctactctctacttctatgagagcaatgttttagatgccacatatgagtgagactatgtgacatttggctttttgtacctggcttatttcacttaacctagtgtcctctaggttcatccatgctgctgcaaatgacaggatttcattcttttctttggctaaatactatttccttgtatacatgcataccacattttctacattcattcatccatcgatggacacttgggttgattccatgtcttgcctgttgtgaatagtgctgcagtgaacatggaagtgcacgtatctcagcttactgatttcatttgctttggatgtctacccagtatacaaccatatgattgctggatcatatagtagctctatttttcattttttaaggaacctccatacttgtttccctaatggttatagtaatttacatttccaccaacagtgtataaaaggcccccccttatccatatcctcaccagcatttgttaatttttgtctttctgataacagccattctaacgggggtgagatggtatgtcattgttgttttcatttgcatttctctgatgattagtgatgttgaagattttctcctagacctgtttgccatctgtatgtcttcttttggaaaatgtctattcagttcttttgcccattttttaatcaaatgatttggtttttgctattgagttgtttgagttccttatgtattatggatactaacccctcgtcagatgcgtcgtttgcagatatttcctcccattctgcaggctgtctcttcactctgtcgattgtttcttttgctgtgtgaagctttttagtttactgtaatcgcctttttctatttttgtgtttgtgcctgtgcctttgagttcttttctataaaatccttgcccagactaatgacacgaagtatttccactgtgctttcttcttgttgttttataactttgggtcttatggctaagtctttaaaccattttgagttgatttttttaagaggtgagaaattggggtctaatttcattcttcacgtcaagattactttgaataaaacttctaaatgaaaattttaaaagttcagccctttgctctgagtttttgtctctattctactcccacaccccccccaactttagtcactgtggaacccacagtgaggtcctctttaaagctggcttgcctgggttttagacttcctcctccttttttttttttttttttttttgagactgagttttgctcttgttgcccaggctggagtgcagtggcatgagctcagctcactgcaacctccacctcccagattcaagtgattctccagcctcagtgtcccaagtagctgggattacaggcacccaccaccatgcctggctaaattttgtgtttttagtagagacaggttttcactgtgttggccaggctggtctcaaacttctgacctcaggtgatccacccgcctcggcctcccaaagtgagtcttcctcttctttaagatctttatctctctgcctttgggtcacatctaggaaatgattcatccccccactgctcagaagcaccactcttcttgtgtctgaacatcttgggactttctaggttttaccccattgctctttcaaaaattccagatattctactttccatatgttttctttttggttgtgaatcagagagtggtagccttctcccatcgcttatgactccttctctcttgttcttcaaactcgagtacagaggctactgtggcggcgtgtttgggtgattgatgggcttcctacacttggatgttatctatgccgggcttgtcttggttacatcccagcctctccagagcaatgatgttctgctgggatctgggggctccaaagtgggctgtatgggctggggatgccagcaaatcttccatccttccatttgcttgaaattaaagatacacagaagtaatgtggccacgggggtggaaggaagggaggatggaactcaaagggaaaatgacatgtggaccctgctctcataaaatttgaaatctagtcagtggagaagaccagatgatcccacaggagaaatctggggtgtcaagtatggatacacagtgggaatgattcatgtgactcactctgctgaggaatttgcccactgccctgacacagacctcactctactggtgaggtctgcagaggctactgaatatttgtaaagagtcgagtctgcacagttggcttccagcaggcattggacagggccctccgtggaggccaggcacccggcatgcagttcccctgcctcccttggcctggagtcactgctcttctccgcaggtcactgcccccatcagctgtggtggtctagtgttcagcagaaatgggaaacggagtcttctgaggctgtgccgattgtcattgctctgaaaagagctcacttgtgcttgagtggacattgcttcagcatcaacgtgaaggcctctgtctgtgggtttcagggggtgccagggaccagactggagagcaggcctcatcctgcgcccacgtccaacctcccttatcctctcccccatgctcctgcatctgcttcccagaacctctcggcctgtaggatctgttctgttggtgaggagggagtacagcataaacacagaaggtctgtgacggagagagattgttgaggcttcctgctggaaggttgagagctgagcagaggcttacaagagggcaggatctggatagatgccaacgaaaacagagcatttgggtgaggagaagagtgaatcgatggactgaggagggaacacacctgtgctatgcccaggagaggaggcaccagcaggcagagcttccaggcagggcgccagggcagggcagcatggaggaagtggagacagtggccttgcctgtcctggaaaagcctgcgagtgtccccatcacttactagtgggggctggatagtcacacatgaggaccacaaagcagatgttatcattctcctgggccttatgtacatctcagtatgtttgggagacctgagcatttaccttgtaaaagttttctggaagaaggaaccaaggtttgatggcagagagtacatgccctgctccaggatggcagagagcacatgccccgctccagcatgtcagagagcacatgccccactccaggatggcagggccccccggctgcagcatggcaggggttccagtggacagtgggcttgggtgtttcaacagcatctcccactgcagggccccagtgccacagttgggttgaggccacagaatccattgcagatgcaggtactggctgagtgcccacagggcaaaggccatcctgaaaaaggggtgggcagccccttcaccagaacggaatgcaagtgctgagccagctgacagggtccttgactgatgggtctttcagtgagaagggtctcctgccagtgtgggcctgcagtcaccgggcagctgacgacaaaactcccagcaagaggtctttccccaataagcctcgagaagagggcagaatggggccagctgctgacgcagctgccatgtctgctggagacatgctgtgacaatgacagggaggcatccttccgtccccacctggttcttctgtatgggtctcatgagtgtgagcttctgacatcaggttccttctgagtgaggaagagaatgtgagaggtggcatcctgattaaagctgtttatggtctggtgcatttttggttaaaaatcacacttttcatttatttagcacattgctgtcaagttgcaacacgctgtaattatcagaccacaagttctggaacctgctgcgtaaggtccaatcctggctcctccttccgctaactgctgaccttgggcaaggcatttaactgcctcgtacaacctggtttcaatcccagccgcacccctgacccaccagctgctgggcaagttgcttaacagctctgtgctcctgtgtcttcatctacaaagcaggaatgatagtacctgccccatagggttatttttaaagattaagcgagttaatgctcataaagcactttcgaagtgtctgcccaacatatacaaaaatttacccgaaatacatcaaagacctaaatataagtgaaaactgtaaaaatcatagaagcgtaagggaaatgttcatgaccttggatttggcaatggatttttagctgtgacaccaaaagcataaaaaataaaagaaaaaataaaaagaagtagataagctagacctgatcataattaaaagcattaatccttaacattctagctcacatgacacctcctctgaagcctgttctaaccccttcagagagaatggattttttataagggagacagtaacagcaacagatgtgactgagcatttacttcattcaggccagccactgttttacgtactttgagttggttgactcacttgctcttcacatccatttaagattagattctattggccatgcacagtggctcacacctctaatcccaacacttgtgaagccaaggcaggaggatcacttgaggccaggagttcaagaccagcctaggcaacatagtgagaccccatctctaccaaaaaaaaaaaaaaaagatacagatagatagatatatagatagatgcctggccgtggtggtgtgtgcctgtggtcccagctacctgggaggctgaggcaggaggattgcttgagcccaggaggttgaggctgcagtgagctatgatcacaccactgcactccagcctgcacaacagagaaagaccctgccttccaaaaacaacaacaacaaaagatgaggttttattattatctctgctgacaaatggagaaactgaggcagataacagtccagcagctggcccaggccatgcagcacatcctctgtgctcccagcacgtgttgcagacaccatcgtgtagtctggagcacactgagctggttagatccagattcccactgtgaatgggaactccttagggccaatgacatccctaaccctgaatcatgggacctcaatgacttctgcaggactgaaagttacatcttgattctggagggatttgggtcgcagactagagatttaaactttattctgaagtaagcagaaagttatttcagatttttaaaaaatacatgagaaaaatcgtgtttcagtaaagacaaatctggtgtgcaacgtatgagataaatcaggggcggcagcaggaggcagggagttgagtgagggtggcccacggttgtgagtggctccaggtgggtggggtgaggccttggggatggtgcgtggactaatccagatagtgaaggccacacgtagggaggcttcaagtccctttaggaacaagaatctcaggaactcagaggagcctgagtgctctgccagccatgcacatggtggataaaaagtaaaaattcagtcactcacccaatatttgatctcagcatccaggatttctcagcctcttgggggttagcatcgcaaaaccacaggcagaacttgatgccttccatcttcttttcttcagatatcttaatctgaatatcaaaaggagaatgtgaggcacagtggcttatgcctgtaatcccagcactttgggaggctgaggtgggtggatcacttgggctcaggagtttgagaccagcctgggcatcatggcaaaaccccatctacaaaaaatacaaaaattagccaggagtggtggctggcatctgtagtcccagctacttgggaggctcagtgggaggattgcttaagcccaggaaacaggtttacagtgagctgagactgagccactgcactccagcctgggtgacagagcaagactcctttctctcaaaaaaaggaaaatgtgaaagatcttcaaagcaaaatacactcttctttatagcttgttctttcattttccttccattagaaataaaaccaaagcaaaaaaagaggatttaatatccatcatagcaaactttactaactgaaaataataattggctatggtctgatttgattcaaaaatccattgtaggcttacaacacatttatttttaaaaaaaaaaaaagctaaaacttagtaatacatcttacccttaggcaaactcataagaacagctgctgaaattaaattaggttgtatacttgtttctggaagttttccacctcatttctggctgaagtgaatccttgaagaaccaggagggctgagcagaaaacaaatatttgccactgctttcagatccatccctctgtgggaacaatctggagaaactgcctttttcatattttcagtaaaaaaaattccatattcatgccatttcctgtattatgcaaaataccttccctccatagtctcttaaatgacactgcaatatttttcctagaatttcctaaaagaaaacagctggtttgatccccactcttggtccgcatgcctgatttctgtagacactgggtatttgcagtctgggctgcatcagtttgtgaggtacccataaggatgtgggcagagagtttagagacagaaaacccagggcagaattgatccatgcaccagaaaatgcattgtgtaggacaatttatagcttaggagcttcaggagacatgaggtggttcctgggtcacaggttctcaaatttggctgcatattgtaatcacctgggatgtttctttaaaatgctgatgcctggattccattcctagagattctgactttgggttggtctggtggattgtgcattaggtttttcaaaagctccccaggccatgtaatatgtatcaaaatctgaggaccaccaacatagaccatctccccctcctccccagagagggggcgacttgcccaaggtcagaattataatatcttccagtgtaccccaactctgcagatggttctctatcacccagtggcccaagagatcagtttgagaacaactttgcctcatcccacaacttcaccccagacctcaggtcacttcccatggtcaatgggttcttctcatagtctcaatggctgatccttctccatctccatggttagtgctcctcagatgatagcaacaggctcctctcatttgaggcctggctcccttctcttcgccacaccatctgcctccatactcatcttcaggagacttgagtgtaaacatgttgcctcctactcacacctctgtcaggggcttcccattgcctttgggacaccttaatgtggcttccagaccctccaggagctggctcctggcctcctgagtatcccatcttgcccctcctgtatgattccgcttgtatgaggtccctggagttgtcagacccctagagacaggaagtagagtaggggtgccaggggctgggggagggatggggagttacaatagtatttaacggggacagagtttcagtctgggaagagggaaaggttctgcagatggatggtggtgatggttgcacaaaaatatgagcatacttaatgcactgaactggacacttaaaatggttaaaatggcaaattgtatgtaatgcatattttatcagaacagtaaatttttttcaatagctttctgagaaagaccttgcctgccctttgcctgagttaggcagctctgttttgtgtttccagaactccacaatcttcctatcagaccactgtcctgcttagagtctggcctttttacagattgtgactagaataaaggcgcattggagttctcgcctatttaccactgtgatcccccatgactgcagagtaggtgcccactgcataattgttaatgaatgttgttgaatgaataaaacccagaactacagtgtcccagcccgtcaatcttaattgctaggaaaaattggattgcaaaaataatccaatttgatattgtattagtccattcttacattgctctaaagaactacccaagactggatcatttataaagaaaagaggtttaattgacacactgttctgctggctgtacaggaagcatggctggagaggcctcagaaaacttttaatcattgtagaggggaagcaggcacatcttacatgggggagcaagagaaagagagtgaagggggagtgctatacacttttaaacagccagatctcatgagaattcactcactatcaagaagagcaaggggaaaatccacccccatgatccattcacctcccaccaggccccacctccaatattagggattacaatttgacatgagatttgggtggggtcacaaatccaaaccatatcattccactcctgtcccctcccagatctcatgtcctgctcccatttcaaaatacaatcatgccttcccaacaatctcccaaagtcttaactcattccagcattaacccaaaagtccaagtccaaagtcttatctgaggcaaggcaagttttttctgcctataagcctgtaaaatcaaaagcaagatagttccttccaaaatacaatggggacacaggcattgggtaaatactcccattccaaatgggagaaactggccaaaacaaagggctacaggccacatgcaagtctgaaacccagcagggcagtcattagatcttaaagctccaaaatgatctccattgactccatgactcatatccagtgcatgctgatacagcagtggtctccatgatcttgggccactctgccctgtagctctgcagggttcagcttcctcagctgctttcacagggtggcattgagtgcctggggcttttccagatgcatgctgcaagctgtcagtggatctaccattctagggtctggaagacagtggccctcttctcacagctccactaggcagtgccccagtggggtctctgtgtgaaggctccaaccccacatttcccctctgcactgccccagtagaggatctccatgagggcttcaccccacaacagacttctgcctggacttccaggcatttcatacatcctgaaatttaggtggatactcccaagcctcaactctcacactctgcacacccacaggcttaataccaagtggaagccaccaagacttggggcttgcaccctctgaagcaacagcctgagctgtaccttggcctcttttagccatggctggagctggtgtgggcgcaatgcagggcaccaaggctgcacagagaagtgggactctgagcccggcccatgaaaccattctttcctcctaggcctccaggcctgtgatgggaggggctgcctcaaagttctctgaaatgccttggaggcgttttccttattgtcttggtgattaatatttggttccttttacttatgcaaatttctgtagcaggcttgaattcctccctagaaagtgagtttttctcttctaccacatagtcggactgcaaattttccaaacttttatgctcagcttccctttttaaatataaattccagtttccaatcatctatttgctcatgcataacaaaagtgaccttggctgccattctcaataagttccttatctccatctgagaccatctcagcctggacttcattgtctatatcactatcagcattttggtcacaaccatccaacaattctctaggaagtttcaaactttccctcatctctctgtcttctgagtccttcaacctgttccaacctctgcctattaccaagttccagagtcacttccacattttcaggtatctttgtaagaatggccccttctcagtaccagttttctgtattcattcccacattgctctaaagaactacctgagacttggtaatttattttaaaaagaggtttaattgactcatgattctgcaggctacatagaaagcatggttggggaggcctcaggaaactttcaatcatggtggaaggtgaagggaagcaggcacaacttacatggctggaggaggaggaagagagcacagggggagggctacacacttttaaacagccaaatcttgtgagaactccctcactatcatgagaacagcaagggagaaatctagccccatgatccagtcacctcctaccaggctcagcctccaacattggagattacaatttgacatgagatttggacggggacacaaatccaaaccatatcagattttaagtagctagaagtatcagaccacaaattgtccagtcatggtaagtgataacattgggtgaagaatgtggaatttcagcctctgattaatccttacaggtatattctgttcgaggtgggtagacctccaagaattttgagactgcctttgttctgtctaataaatacaacaggaaaatgaaaacccggttgatgatttcagattttttaagaacagcctatttataaccacttccttgcttaatattatgcttttttctctttccaaattagatatttatttttgaaaacaatatctactactgtgcacatgtcgggaaacaggccatccgtgtggtctccactggcaaggaaggtgtgatttacaatggcctcagtgactggctgtatgaaggtaagatgtgcacagagagaaaaaaggaagatttgtggttgctgctgctgctacattggagttgggttctttttcatttttctttgactttaactgtaaattaaactccagtttcttgaggttctgcaaaatttaaaagattttgttagagcttttgggatcaggctgatcagcatcagagaacagcatcaggctgttgtcaggggcctgcagtgttgtgcactcacctgggacaggtgtgctggctttgggctttgcagagctctgcaattcatccctgaagggcaggaggctcgttaatgggagatttattatgtcaggaggtgacttctgggaacgctcagggactgcaaatgcatgtgtctctaccccactccaagacataagtgcctcgttttgccttgggaaggggacagttggaaaagaaagaatgagttgcatctttccaaataaatcatcagagtgacttgctgctgagagcgcctccaccttgctggacattttctaccactggtttgcctttggcaccagaagactcatgctgtatacattattaaataactagaagtcagagggggaagctctcttcttaaactttgataacctgtctccatgctcatgacccttcatcgtaacaataacaaccaggtattgattgctattagctgtcaggcactgctggaagcactttgttttctgttacttcattccaccctctgtcttagtttgttcaggctgctgtaacaagatataacaagattccacagactaggtagcttaaacaatgaatatgtatttctcacagctctgaagcctgggaagtccaagatcagggtgctggcagacccactgtctggtgagggctctcctcctcacttgtacatggctgtcttcttatgtcctcacctggcagagtagagagagctctggtctttttatctctttataagggcacaaatctttttatctttttatctctttataagggcatgaatcccattcataggggcaacaccctcataacctcatcaccttacaaaggctccacctcctaaccccatcaccttagggatttgggtttcaatatatgaatttggggggacacagacattcagttcatagtactgtcataacaaggttctattttatagatgaggcatggttaggttaaataattggcccaagtttacacaaggtaaggaatatttattggggaaaggcgttgtccaagctcagggtaattaccttttttgaattccacatgtggctacagtaaccgtatgctttccagcatggggctgatgaacaacccaagctcttctcagcctcctggcctgaaaccgtgtggtcacagcaataactcaccctgctaggctgggtcaagggagggtcagggagattctgggtgctttctcaagccagtatcactttctcctagtgctgtgcatgcctcattctgcattttagtggctttatgcatcataaattataaagcagatggatatgcaagcttagtgttacctcctaggataatttctctgaagccataaagttctatgacttgatttttaatttttgtaaatggaggtataatttgtacataataaaatgtacatcagaaggacagtttgatgagtttggcaaatgtatatactatatagccccagtcaagacatagaccatttccatcagtctagaatattcctacaagtccctttccaagggctttctccctaaatctgtcttccagagactgccacggtcctgggggctaagcagcccattctctaacagacatactggaacccaagcatccacatgaggctgtccttccctgtgtggtcaccatggaagccccatgtttattccaatgtggctgccggtgctcagagcatgctgaagagtccagtttccttctgagccccaggagaatcaaccctgagattttattgtcacatgagtccttggctacacctgaaaaagccactggaatgaaagaggggacacagtctgctgtagttatgcctgttctgtgcagaaacagccctagaaatggtgtgcccggagatgtccccagctccaccaaagaggtacaggcagcagcacaaagggaagctccggaggggctgcacctctgcctggggtgcaatccctgagcctctggggcttgcctgccccctggactcagtagactgttgacaatgaggactctaaagccccttgtgtgctgcccttttgtgagaaaaaggccttatacctaggagcaactggaaaactgggtcctgtttgctccctgatatctgagatcccactaacagctcttttgcttgggtgtgagatcagctcaatatctggatagggaagggaacccaggggctggagatcagaacatgagtggttcaaagtaaggctgtggagctgcagggacccagggaggagacctggcccagtcacgggacatgacaagggtcttccactccatcgacctcaacatgctcatgtgtacatgggaagaatgccccaaacactacacttcctgaggactgtgtgagacttggagtggaatacgtgcagcacatgacatggtcagcaagggacagttgctgctgttgtttcttatcacaataaaaataacaataattatgtatttattactattattgtaattatttgttagtagtatttttatcacaaaggaaaaaagatgtttaaaaaagaaaaaaatggcatagatatcaaggcaatgttacccaggtggtcattctgccacagggcagaaattgtctgacctgaaaattcaagagagatcagtgcaaataataatgaacccaaggtgtgtcccccgtccctaagagaaagggcccctagaattttggctgcaagagcctaggcattctctgggactaatctccctcaaaaatccataaccaggagatttaaaatatcttttttagtatcttcttaataaaataaaaagttcattgctttgccattcacattaagcttttgctttagcaaatccattgaaaggacttttttcttcaaggcatttacacgaaattgtgttgatgtgataacagagccctaaatattttaaatcaatcacagttgatgtggcagcttaatctacttagtgttgttccctggaaggtttatatgctgatgcttagatttctgaggctgggagcacaggagccctgaggattcttgcttccttttttaataatgggaaagtaaactttgatgatcgcttttgcctactctgtgacttaactgtttcaattccaaacacttcctttaaaaaagttagggggtggggggagattagaatgaaaatgccctaaagcatttgcagaggggctcatttgcttggagatgttagttctaagaagataagctgtgtacgtgggaaacagccactgcagtccatagcttgttggcagaaaaatgccttattgatttgttttgtttcccagaaaggatcttaaacatactaaacattgcaaaatattggagactgaggaagagaagaggtgggcagccatagaggcttctgggagtctccaacccttgacctaagctttaaacacacaaagtgggaaaagctccagtttactgaagcagtcgcccacatgccagaatgtgagctcaacactggctgtgaactcagcactggctgtgaactcatcactggctgtgaactcagtgtatctgtcttgctgattctctaaagagagtcctgtggctcatggtggccacaaactgattttgataagcaaaatgcatatcttcattttattcttctgggaaaatgtcataaaattacatcgaattttgattttaataaaaactaaagacagcttaatagagtcctacaactttttaaagtttattaaagtttgtttattcataaactaaacgtaagatgttactgaagatgaagattttgaggcctgtgagtgagtgttctgttaagaatgtgcactttgatgcagggctcagtaattttgcaaagttcctagtatgtaggcatatgggcaaagagttggaattctccaagttttgatgaaagttctttgttaccgccattacatggttgattgtgtttccagctgccactctttgtttataaattactctttgtttttcttttgtttgtttttttttttgagatggagtcttgctttgtcacccaggctggagtgtagtggcgcaatctcggctcactgcaagctccgcctcccagggtcacaccattctcctgcctcagcctcctgagtagctgggactaacaggcgcctgccaccatgcccggctaattttttttttttggtatttttagtagaggtggggtttcaccgtgttagccaggatggtctcagtcatcttcgttatcatcatatgcatgagctatagtgggacagcacagaatttttggccaataatttgctaataatgactttaagttattaaatatttcagctaaacaatgagtcatccatacttcttttaccaaagcagtcacatgcatatgcatatccaaaatacatataattattcagtgatatgccattatcatggaatgactcacagccctgtggaaagctggaacatgttagggtcattggaggacaacatctttccttatgtatataaaagatcttatcccctcaaagggcagtggaggtagagtgagggatgatgaactcgagaagatatttatagagctcagcctggagtcatcagcctgggatggcagggaaagtgagaaaagggcccgaagggtatttatttcatatctggtttggcatggatgaaattccagggctggattttccttaactagtcaagaacataaaagtacttgaaaaatgtgatcagatcaggagacccagtttggcacggaagcatttccccgtgcatgtcagcaggaatcatgttagatgagactctcgaagctgcccctggcactagttccccttgcgtggttctaggacccatgcagtcaggcagcccctgacaaggagtagctgctgggaagtctcctgccaacaatactcacttctgctccaccctgcccagtccaccgccctcgcctggactccatggcaccctccccattttctgcagccctgccctgactcctgaggcccccttctcccagtcacagcccttgccacagtccccacggagccaccgtcctggttccacctacctgggagcccccaagagagactgtcttcactgtcccacactaactgccaccttcactgggtggccagcatggaggaagtggggatgtggctagtctggccagaaaggacttccttccagaactgctgctgctggagaggggtttagtgcctcttgagttggaactcagaatgctctcattagcgatgtagtcaggcccactgtacaaggagcagagcctttcctaagctagggccctcagtcctgctggatgagcaccaaaccctggtggtgtgaccattaccctccatctgtgtgtcctgctcatgtctagggactgcaaggccagcgtgaggcaaggcctgctttgcacttctttatagtttctcaaagcatctttaaagagtcagcactcatgacctaatagttttctgttccaatgaagtgctctaagaggtaccagcaaaaggtcaggtgggccccaggcagataaatttgagttaatgaattttgggggtggggcaattccatgctttattgtcttgagtattcaaggaggtggagagtgtgtaggagtagtagtgcagtgtagtagatcacagtggattttcacactttcatggaagaaaacacattattaaaatgaaagccctcctggggatcgtggaatggttttcagggtctgttttccacagggggcacattcaccaaaagaaaagggaactctttgttcatccagattcccataaactctctaaatcccatgaaagcagaacaaacttaagtaacacttcacgtgaaacttgcatattggctttaatttacattcatgacacgttagatatgttgtacactttgtgtgccttgtgtcacgctgatacccagtgtgctgagtacctgcttcctgcgtgttgtgaacagaccagagccagttgtgaccatcgataactggtacagtcttcagtgaatagcggcagccttggacggttcgacgcagatgaagaaaatctagcacaccatctttttatctaagaaagcaatatgctggaaccattagacattaatgacacttatgctacttttctttagagacaggctctcactatgttgcccaggctggcctcaaacttgtgtgctcctggcttcgcctcctgagcagctgggactgcaggaacctgccactgagccccaaccttttatgctgtttttaaaactccctgacatacatttggagactgatatgtgaggtgcttacagaagccccctggagtgtagattcttgattgggttctgcaaatattaactgcctctgaagcacctggctagggcacttcaactgctagcaaactgctcccaggtagtagatcaaagtggatttttacacccgtcatacatcttagtgaccatactgatgttttttaaataagttatggagcaggcagtacaatgggaattggaatgatgttcaaatatgtacattactatgtaaaccatagatctgtagttatttggacctcttattgattacatctcttatttgcatgatgggaaatgtttggttagacaaggacatcactctcagtaaattggcagaaacttgtgattagcttgacaaagctcctttgtggaagagcagggcagagtctttgtagtgatgatgcctgtgtttaaacaaaagcttcaccacgtaaaagctgtatgaacttggatgaatatttgacctctttgtgtctctgctgccttgtctgcaaaacaaagataacagcagtatatgctccataaggtcacagaggaaattgaaataagctaatacacatagagctcttagaatagtgcctgccactggtaacgtctacgtattggtggtacaactactattgctttaccttgtaatttcccaaactcggtaaaataagaggcacctgctcaactatttcatttgcaatgtcaggaatcggaagcattaatgtgtaattaatgatacctatcagtgttgaaaactctgaagctctattcactcataaaatattatctgtagtatgttcacatagaaaatgcactatgagttcccagtcatcctagaaatgctattgataccatgttgaacacctcttcaagagccttctgtccacgtttagattctccaagctgaaatcacacccttagttgccactgatgcctgacagagagacagctgttttccttttatgagccccaaagttcttgtgacttggtaaaaattatgcctcatgatctcttacagaaattgagtacttaaaaaaattatattccacttcatctatgacttctaagggaggatatgaaagtaaaagtaatgatgaaaatatctaaaatgtaatcagtgtctggcgaagctatcagacctatgaggtactgtgcaatggagcattggctcaatcaaatagcaatcattctgagcaggagtctgaatgctttgggtatttcatgtaactaaaatgagtattttccttgtctagtcctagtctccaactctgtaaagtattaatgatcttgacttgaagaacatgttaattttaccttgtagagagacaaggaggaaaagccaagaagctgtttggtagaagttcagttggctctgaccagaaaatggctgagatggcctaagagttccattccttctgtgcttctctgaacctgtgagagatttctgggtttctagatttctgcaaggatcaacaggaaaacagtgttctaaggcaggaaataagaatgtcaggagcataacatagactgtgattgccacaggtaagccaggctggctgccaaggccctcttagccccctgggtccaactgcacctgttcctcacttgaccctgagtcccaccagaccctcccctgccatcgtctgctctcaacgtagcaatcatggcatcatggctgcctcagtgccaaactttaaatccaggtaggtcaccaggaaacaccagcacatcctaaccagcaccatctctctgtttctgcgatcatgggcagaccactatctttctgctgtaacaacacaaagtgtatgccctcacttgcctatgttcatctgagttttcttgaaagaaaaacacatggctattgattctctaatcacagaaggaggtagtgttggagctgaaatggacgttagcagacattgagtccagcagtcagtaaactgtttctgtaaatggctaatagagtctgggtaatagagtcagggttttgcaggacatatggtcttcattgccactgctcaagcctgttgtcatagcaaaacagcagccatacaccataagcatggctgtgttccaataaactttatttgtggacagcgaaatttgaatttcttgtaattctcacatgtcattaaatattcttcttttttaccagctattaaaaaacacaaaaccaattcttagctctcaggtcatacaaaagagacagcaagccagatttggcccaaaagccatagtaagccaatcccaatttgtccagtcatcacattcacagacgaggctactgacatcatgtctgaattcttccagctcttgtcgtctgtatcaagatcatttgtaatgacaaccaattatttcaaattttgcttctccaaataagtctagttacttgaagtcaagaactgtattttatattgtatgtttcccataacaccagtgactctctgagtacttaataaatgttcagaaaatacttttgaatgagttaattcacagagagaaactcacatattctaggaacctccacaaggaaatcatattgtttctccatgatcactcttattagaatttccatttccacaaaattccctcaacagaaaaacacctgattaacaaaaagcaacagtaattgttaacctcgttttaattatgagtttcacgttttatccccaaggataaaggaaaaaactggagtgacgttgggaaggacatggtcttcttaccgtgagcccaggggcacaggatcatagctcatcagactctagaccatctaaattcatgctaagtcatagttcacatactgaatgaatagagtaggaatagcagtatctaagtttcagtgagtctttcttccatgccaggccttacacaaataaacttcgagagcgctatgaagaaagctctaggattgttccttggtatcctcgggagactggttccaggaaccccactgcacccacccttcttcaatcagataccagagtctgaggatgctcaagttccttgtgtgaaatggcttagcatttgcctattacccgtgctcatcctccgggatactttaaatcatctctaaatcacttataaatacctaacaccatgcaaagcctatgtaaatagttgatatgctgtattttttatttgtaatattttttatggtcacactgttatttttttctttaatatttttgatctgcatttggtgggagggtctagagatgtggaatttttagacacagagggccaactctttccttatcctattgcacagctgtggaaactattaagtggcctttctgtggacaaacaaccagtagggagcctgcctgaagctgctaagcactttcctgctgcatatgagttgcattaatttcttgcctatgaaattaggcttgggtccatactcaagttctgggtgcagcatcctgtagatgtgtctgctcaatgccccaggcttgaaccatctgtgctgtaaaaggtgtgtctcatggcacagatttaagagcccaacagaccttgatttaagccctctgtgagccattcagctgcctggtgaccaaatcacaaaccttgtctgaccctcagtttcctggtctggatgataaaacttcaggcacctttctcaaagaattattgcaaagttaaacaagagcgcttctgtggaagcgcaggcatattacagtggaaccataagaaattgccaacaggttcattgtatattagcatgtgcatgtgagatgtccggtgaaggtcaactttcttctcccatcctgctggctatgctggatgagatctcagatatggtaaagtctcagatgtctgcgtgcccagcacagagaatttaccatggaaaaggcgggggtattttttgactggaaggtcagacctattcacctccaggtatagcatctccagggcccccccagcaaacaggagataaaagggatgactgctctcctggtctgtgggtttctcccaagagaaacttgacagagacttccttgctccaaatcttcctcttcgtggctccttgtttctggtactgattcccaccaccctcctaattgccatggtgaccagtcggtttgctatttaattaatgttgtatctgattacatctgtaccctgggagttctccagccaagagttgcaatttaaactcagaaataaataaaacgttcagctgtgaggatgggggaattatcctagtcaatcccggaatattcttccgacctttcttagatgaaaaattatctggtggaagttggagtgaggcagtagtacacaatgaagaaggaacaatattctgcttttggaatatttaaaaggaagcctcagacagcagctaggggtcctgcttagcggatagagctttggaaagaggaaatattagaaatttggttgagaattttctatgaagttcagtgctaagagcagagaccacaacttaggctttgcagccagcattcccttccataaacttcaaacgtaagcctgatcagaacaaggctagcaggaagatgtgctggtggggacaggctaggtcctgctgtgggtagcaaaaaacaaacaaaagcaaacagaacactgcctctaatttaaaacagcaaagtgtatttctcgtcggagatcactcaagcccactctagatcagggatggggaggaggtgaggctctttccctcacggtcactcaaggtcccaggctgctggggctgtcctcttaggcatcgcagccacactagtggaaaggggagtgttccggagggacacaagctggggaataaatgcttggcctgggaatgaccctggcacttctacgcatgactcattgtccagaacacctcatatggtcccaccagggttccaggaagtagcactgagccattgtccagaagagggggaggccagacatgtctgggaggcaggactgaagaccccacatctgggcagctttcttgccaacagtgggcctcaagtttggtgcccaaagcagaagaggaattgtctagagggatgttggggaatctctcagaatcaacaggaagatcagagttgggttgagaaagcaggcagccgtccagggcagctgaggggacgccaggggtccatctggttgggacactgctgtgggggaatgggagtatgggagaggcattgtctgcccggatcacaaatgacgttcttgaatgagctgcaaatagaaatgccatgtcccccatggaatcatcaatatggcaacttgggaagcgtattccaggaaaaagctagggtgtgtaacgttttattgttgcaaactctatcatttcacacttaaatgataatcgcaaggagagccatcagaaccattagtcatcatctcttcaatgcgaaggttcgtaattgtcacatgcaccttgcaataaggcaccttgcaataagctcccttccttcttggcatctccttggagcctgtgaagtgatgaatgcagttcccaatgcacagccctcaaactgcatgggagaaaccccagtgtcccagaggacagtgggggcggcttcagcgtggctgtgtggcactgaaacaggttaaccgcaaacctctagttctcagaaccaaagctgaatccacatttgaaaatccagtagaagctttgttaatattttaggaaggctattgagtattttaattcaacatgaagaggtgatctagctggtcttgtgaaaaatcagtaataaatctaaagggagaatgttctctaaaggtacaggaagaattctcattggtcttgagaaatgtccttacaattaatgacctactcctgagagatcgtgacaaatatcttaggatgttcagtgactatatttttctatctttcaaattatgcatttcattgtgagattaggacaaacacacttttacctttttttatagcgccctaatgaaacttatgtatttgaggttgagatatttgacacccttgggaactctaatttcttttttttttttttccgtcttcttaagtcacctaaggacattagaccatttgccctattattgagagttttactaaaatgcaagctgcaaatgccagaaggaagataggcaacaagacaatatgtacttaaaagagtttcatttgatactcagaagctggaactagacttagctcttttgctcactaaacctgtattctaacctttttgggcctcagtgtctttttcttgttctggaagcatcactagggtggaccagataatgctaaactcctttccgtctctaacccttttcatgtttaattatcagtgccataagcacacagcgttgatggtatgaagtctgtgtccatgccagataacttcacaaggaaatagttaacaattctcggttttacttagtaaacatacgggagcaatgctcctcagttgcaatggtgggggctgggcacgtgggtatctcggcctttttgtccccttcctctcccctttcgtcacccccacacacaggacatttgcgtactgggagaacctttattagatgattctgataaaccttctccttatccccacgtgaaacctatctgccctaaaggaatcagtcttctgtctcctttactccccatttttttctttctataaaatttgcattattggcataacttttctctttactatgggttatctttgggaaggtgtaagggaatgcaaagatagctcacctccacgtcagagctccctgcacttgcaggcgtggagaggacatacccttcgtcactcgttctgtgcgttaggaccagagtggaagaggatgcgaggagtcagatttcaggtcagttgctcttccccagccttcaagcaatggcagaggctgtcctgggaaggtcatgctcttctgtctgggttatctgaagtgatcattgcaccgagtgggagactggacatgcagacctatcatctgcagccatacaagctcatgattctgggcaccctgagtcaagtcccagagcccaggcaacctggcagaacccaggaagggtgaagcctctgcatgctggccactcaggcctacgattagcccctccccagcacatccgtgcattcagcgcaaggccaagctccatccagtcgatggaaatgggcacctgagcctcagaaacacccaaagaagagagcacctttcagctcttcatggaagaaagcgagccagccagcaccttcttctttttgcaggaataaatatgtctggcacctggattattttatttaaaaggccagctgtgtggacaccatgcctataaagtattgggatttttaatgaatgttaaccaaggaagagcccagctaggatacttcctgtaggtgtcactttgtggaggtcttaggtgctatccaaccctaaggacaaggcagccaggccagctgaaggatttcagatcagctctttctctgctcaccaccctcattattatccacttcttttatgggtccactcagatgctcatgctcacagtcttacctcccttctctccatccagaaaggtgaaacctcacccaccgccatgtggctcccacatcccagtgtcctgcatctgtgtctccagaaacatggcagagatagaagaaatttacatgtagcaaaattcatctcttcaagaagatattccaacacctgacagtggcccacacagtcctcatttactagggaatcctatttcgagccccttctgggcgcccagattggatgagtcactatggattgcagtgccccacccaacggggtacctgaaaaagaggaagaaagggaggcagggagggaaggagatgaaggaggtccaagacagggacccttcccttgaggaactgatacacagtcagtccgatggaggccaagaccacctgcaggaagcagctccttccttccattattcgagtgggattcatgcatttattctgcaccgaagccctctaccaggtcctccaagggagacagagatgctttaagatctggacctgccttcacaaagtgtatatcctgcaagatggtattgaaccacatcctaattacatggcacaaatctttcacacatttagacacttttggcagaatggtatcttctgatttaaaactgcagaaacatgaaaattagaaaaccaaacaaccattaatgcattaactcaagagttcattcctaaaatccaaatttccttctctggagataggaccagatcatagctcccaatcttttctccagtttttgttttacgacatttcggatttgagattctgtaagaagtgacctaatgtgagcatttcctgatatggaggagacgcaaaatagctcagggaaaaagttgatcattagaaaaatctgtggttgtcccactgtctcatcgtgccactgggagtttctggcctccgctggcatctctgatgaatgttctatgccaggacaaagaaggcgggcatgggccaggcagtccctccagtcagggaacggtggcctctcccagctgccttggtgtttaggaggccctgtaagggtatttgggatctcaagagcctctgggacttacgggcaaagggcagaccttaagagccagtccctcctcccccaaaatgtttagcaagccagaaattcccctttactgctaagtcaaaggaagatgttctttgactcttcagggagcataacgtaccatcctttgatggtcatacacattaaaagaagataaagccagaaataaaagggaaagaaacagttatatgattttggtgggaatttgcagaaatacaggctgaagctgaagtcttccatcaggtgaggttttttccattgatctcatctctcgggctcagctcttttatctccagcgcattttggatgtggcttctctttccacctgctgggcctttagatagagtacttccttttgtttcaaggtagcatttaactgagtctggaaaaaccatcattaagggaaaataaagctgaaagatgaattgaaaactatgtaaaagggccctttcaggctgccggagagattgcctttccagcctaatgagcctgtgctgcctctgattcagatggtgcaaggacaggagaaaagaatggagttttgtgcactgcgattttccaaagcacataatgcttagtcatttggggtgttaggaaagagagaaagtcggagcggagtgtgtggtgaagtgagagaaagaaagaaggctgaattttcgttaagctgctcaaatgcctgctttaacaaaagtctgccagggctagaggtgattagccatcagtgctgctgctgtttttgctgtcgtttttgctgttgctgaagtttaaaggtcctgtgccccttggtatatacgcaggggattggttccaggacccctgcattaccaaaattcaaacatactccagtcccagtcagccctgaggacccaggtatatgaaggggtatatacgcaggggattggttccaggacccctgagttaccaaaattcaaacatactccagtcccagtcagccctgaggacccaggtatatgaaaagtcagtcctccatatacagggatttcacatccctcaaatactgtactttccatatgtatttggttgaaaaaatctgcacataagtcgacccacgcagttcaaacctatattgttcaagggtctgctgtcccgtccttatgtgggatggtgacaagcggccctgtgtcccatggcgtgcagctgagcggccttggtgcagaggtggatttgcagccagttgtccacacatcctggatcctcccggtgcgtcctgtgtaatgggttaactggacctgcctaagcctgggcctcccacccctcaaaagcagcttctccaagctttcctacttaaatttctccagccacagagagaagcatttattgtctctcaccacacccgccccccagtatagaagaaaggaagactggggaattgatctctcagagcacttggagaagccacacgtcagcagccagtaaagctagaatgaaaatctgagcgatcaaggcaatggaatagaaagtcaaaacccaaacttcatctcttccccactaaaggaacgggaagggacactgccacctggcggccagccgaggcatgttcggggagccgatcctcctccctgggccccccacggtgttgatttgtgggaatttgcagatctctgatgataatgaggggattcgcagtgtgtgatatgcaaataacacagctctgattagtgaaggaggctgcgagccttgcaaggtaaaagctccatttgccttctggcttgatgttcgctgatttcttttttaaccccccatttaattctgctctcggcaccttggataaaatatttagtggcaggaaaaaggcaacagatgcaagcaggaataaataagattttctgtatttagaatgaggccacgtatttcggagcacagatctatcaggcatgttatttatgtcttttgcaatttcccgggacccagatttctcagggtgctttgatttttctcaaatatctacagcagtaggggtccagggagcccagggagcacagccaggcactcactcacagtcagaatccagggggctgtgttatttaggatgatccgaaacgcgaccttgctgcctgcattctgttttgatatgtatcttgcctcattaaaagatgacaatctgcaatactgatattactcaggcagatggatttcccaaatgctgggctatagcctgggctgccagactgcatgaggtttaacatggaaaattaactgcagtcttgttctctggtctgccaggtccagcagtgtagtggaaggagcaaaggagcaggaatcaggagactcaccaggatctgccctctcctgtcctgtgatcctgagaaaatggcttggtctcctcatcctggaggtctccatagtggagtgggctcaacatcacacctggagtcaagtcaaggctccgcacgtcccagtgacctagagccagttgtcaacatctctgagcctcaaaattctcctttataacaaataatgtaagcagatccacagtcactaggaagattacaatagaattgccagagtatctagcattcagtaaatatttattaactagatagaaaaaaaatgtaccaggcttagtaacacccggccttcccatctcattagaggctagaatgctcaatggacacagggtgtgtcttagtctgttttgtgttgccataaaggaatacctgaaactgggcaatttataaaaagaagagtttatttgcctcagggttctatagcctgtgcaagacacatgcaccagcacctgcttagcttctggtgaggcctcaggctgcttctactcatggcagaagatgaagtggagctggttgtacagagatcacatagtgagagagaaagcaacagggtgtttaggaggtgccaggctcttttataacagcccgccctcacaggagtgaaatcaagcgagaactcactcacccttgggggaggccattaaccttttcatgaaaaatccacccccatgacccacacacctcccactagaccccacctcccatgacccacacacctcccactagaccccacctccaacattggggatcaaatttcaacacgaagtttggaggggacaggaagccaggccatagcagggcatatagcattggcatcaaagctagggtgttgattggttatgaatattgttggtcctgcctcatttatcaaggaaagaagaaaaaagaagactgtagaaagactaagttcagggtatacatgagtcttcaagagaagccagacaacattccaggatttcagaaaggggacatggctgagctgggtcttctctttgtggggagacatgtcattgggcctctgagttccaaagacacaacctggaaaaagcacaaaaagactgtctacttagaagatttaggatttcccgcatagtccccagggcctcctctgatcctttgaccaagatatgaaagccctgccatataagaagaggggagctccatgctgaggttaggacacagcactgatatgatgccggccttccttggtctatttgacacctaatgaggtggggacttgttgacaaagtccttccatcgtgaggtctgcacccctcacccccagcttgattgtaccattctgttttggaaatccccaccagaagtaccagcaaatgcttcttaagcttctagaaatttctatctgggattattttgttcatagagcaattctggcagccagagttacttctgcatctttgctttggaccacaatcacccaaaaagcattaggagaaaagagatcacagcaatggttcactcaattttcaacttccctatgctgtttagattttggcaaaagagtattcactgtgactgctgcttttcactataaaaagaagctgagatttcctgccaactatttcacaaaaacaaacagaagattcattgagagaaccaaggaagcatctgatcctacaacacacgaccaaaatatactgtctgtatcttggaaatgaactccctaagaggatagaaaataagtcgttcaagctcttctctaactcaagtataagcaccctataactggaattatgtcttttacctcctgcttattcccagggctgaggggaccattcgtagctgataatatcagttacaatcatgcaggatcatccaggaataaaaacattggaggaaggcagcatgaaagggaaagaaaatcctggttttcagaaaataacatggagacctcatgagctcactctgagtaatcacccttcagcagtagcatctccctatccagtctgctccgtttaagggaagagttcatctcaccacagtgtttcattgaagagctggtttttaattggccctgtaccacttaatttattttcatttgcattccaatgctgtctgccttgtactgctttacttcaaagctggatctaaaaaacataggctcttagaaggttgcaaacctgcaattgtacagaggctctgagaagcgaaatgatttgcccagtgaaatggggtagtgtggaaactgagagagctctgaagtctaacacccctggcttcacaattctacctccaccatttactggttgtatgaactcaagcaaattgattcacctgtcagacctcagtttcctcctctgtaagatggaactagcagcatcgaccttgtggggtcattgtgcgaatcgccatactgtgttagtctagcattgctagtcacttactaggcactcgcgaagtgtagctgactcctagtgttgttgctcttagaaaacacccatatgttagaaaaaaaaaatagaacactttttctgcctctgaataagtgcctaagatcctctaccacttcttgctatgaccacccacccagagtaaggaagacagctgctcccccagcctcagcaatgcggagacggtgtccaattctccactgacaccctagttttttctgtacggtgcatgggaaaatgtataataaaaagcaaagtgcgtcacaaatgataggtagtcctcacgttattagtagtaatagttgctatattgagtgctgtgggtccaggcagattggtttatagtcactgagatatgttgatctaataataatgagaatgaatagataaaggggtacaagctgtcagctgacaataatgtctgaataacatcagtttggtttgcttacgtaatgggtcttacatgaagaggagacactcggaactcaacacctgaactcctcccgcttccggcaaggagagaggcagaaggcgcccacgtggtggacagcagcccatgtagaggggccacagaaaagggtgatgggcatcctctctgcacagggcagagctgcagggtgttgggagtcggcttgctcctctccacctcctcccttctgccatgttcccacctgtctcagtcagtctgcagtaacagctatagaatgtcttcatttggaacttggagaatttgcacaaagggaagcagactggacaaagagctcagatcgggggtctccgggtctgggcacagccgttacccttcccctcccatcctccgttctctcctgccgccacccacactgtgctcctggtgagctagagccagagcgaagtggaacccagagcactgtttgccaacacccgcggcactagacaacgccaagagaatggcttagtaataatgagataataacttaatgaaaaacccctgcgagccctgcggggcggggagggagacctggtgtgtggtgctggacgcttcctgagcacctccctgcacagcctgcctctggagtttctcgcgcatggcggtaagcagggccaggcctcactctttccccttcacagtggagggtgtgagcagggcttcgatgccttttgctcacggtgtccagcagtggatgcgctggttggaacggacgtgcctataaccatgactcccaccgaggccttgtcctgcaagcccagttcccatcaacagctcattctagggagggtggaggcccagtaccgcaggcttgctgcatttgggtatttccaggtggctcaagtcaaacttaagagcgcgacccattcggaaaatcaagtgaataaagcaggatggcatggaaagggatgggggctttactgagagagggtgagggaggataggacgggacaggagagagagggatggaggctttactgagagagggtgagggagcataggatgggaaagagagggatggaggctttactgagagagggtgagagagcataggaccggaaagagaaggatggcggctttactgagagagggtgagggagcataggacaggagggagagggatggcggctttactgagagagggtgagggagcataggacaggagggagagggatggaggctttactgagagagggtgagggagcataggacaggagggagagggatggcggctttactgagagagtgtgagggagcataggatgggagagagagggatggaggctttactgagagagggtgagagcataggacgagagagagagggatggaggctttactgagagagggtgagggagcataggacaggagggagagggatggcggctttactgagagagggtgagagagcataggacgggagagagagggatggaggctttactgagagagggtgagagagcataggacgggagagagagggatggaggctttactgagagatggtcagggagcataggacgggagagagagggatggaggctttactgtgagagtgtgaggaagcataggacgggaaagagagggatggggcattactgagagaggatgagagagcataggatgggaaagagagggatggaggctttactgagcgagggtgagagagcataggacgggaaagagagggatggaggctttactgagagagggtgagagagcataggacgggaaagagagggatggaggctttactgtgagagtgtgaggaagcataggacgggaaagagagggatggggcattactgagagagggtgagagagcataggatgggaaagagagggatggaggctttactgagcgagggtgagagagcataggacgggaaagagagggatggaggctttactgagagagggtgagagagcataggacgggaaagagagggatggaggctttactgtgagagtgtgaggaagcataggacggaaaataccagagtgcaatagagaaggtgcaaaggagagctgcttcccacacccttgctcctggcctgtgtgtgtccgtgatgctgggtcatggtcaaaaacacggatggccgctgacatgggtctttacagagaaaggctccatccaatctgaaaggcctgcagcaggcagaacctatccgtagatgaacaccctcgctctccagaagacaagaagcgggagtcgcagcctattgaagtgtagacatgatgtctacacagccaccctgtgtcctgcaagagcccaggctcagagcgtgtgcaccgtgagggccgcctgtgccggagcaggccgcttctccgtagcaaccacatcccacagtgtggaggttcccagcggcgggtagtgcggaaaacagggaaggcaggaaagaaacttagccaggcactgagtgcgtgggaaggcaaaacactcttttctcctcccacggcgggggcgctccctgggcgatgctcacggagagtgggagggcgtcccgcaccgggcagagctgaagggtggcgggggtcggcttcctcctctctgcctcttcccttccgccacgcttcctacccacaccagccagtctccagtaacagatatagaatgccttcatttggaacacggagagacaagcgtgccgtgtgggaaggagagaagccgctgctggagcaagcgtggtcccagaggagagcctgatttgagttaaagcgagagggcaggagaagcagttgggaatcgaggcagtgggccgaggatggcccaggttcaagaggcacagtgggaggctgcaggtgtaaggagaaggacggctcaggtgagggctgcacaggcgctgaggggatggggctctgggtggtgacatctccaaggcaagagagcacgtagatttcagagcaaaactatctgggtcagaatcccggatccaccctttatcactataaaatgttgggcaagtactcacagtgcctctgctctctcatgtataaaatgtgaggaaccatagcaccaaaatcatggaggtgttaggcagatggatgtgctgggaggaaacctgtttactagggggctgggttggagatggggagcttcttatgatgtctgctgtcagcagctttaaaggagatgtgggtgtctatcctggtggtctccctatcagcctgggatcaggtggtgagtggcttcacctactaagcccaaagatgtgttaggaaaacaggccgatatctatcgataaggaaaactggccggcacgatggctcatgcctgtaatcccagcactttgggagaccaaggcgggccgatcacctgaggtcaggagttcgagaccagcctggccaacatggcaaaaccctgtctctcctaaaaatacaaaaaaaaaaaaaaattagtcgggcgtggtggtgggtgtctgttgtccccactactctagaggctgaggtggaagaatcgcttgaacccaggaggtggaggttgcaatgagctgagatcgtgccactgcactccagcctgggtgacagagtgagactctgtctcaaaaaaaaaaaaaaaaaagaaaatgaaactcaaagggtcatgtcatctccgtcatctcctaagtgctgcaccactaaccaggcagataggacagacacatgtccagaacatcgacgcgggcccatgtgcttccctagagcagcgcccccgaggcagggacggataggacttccacagcatcatcgtcctctgagagggaagaagcaacgtgggagggctgcatggccggtggggggtccctctgggatgtgcatgatgctgggggaggggaaggaggagctggagacagggcaagtcctggtagcagtgtcaccctaaaaagggatcctgatccagatgccaagagagggttcttgggtcttgtgcaggaaggagttcaaggtgagtctcagagtacaatgagaagacagagtttattgaaagttgctcagttacagagcagggcgtccttggaaagcaaagggaggaatgcgccatctttgtttttctcatataggggccttgtctatgtaaagactgaactaagctgtgtctgcttgggtgggggagccgacagcatgacaaaatgtatattattctattgttttaaagaaaaggatccttaacatttcagtgtgtaagtacatcaaagcataactataattatctccaaagtgataatgttaccagtactggacatcaaggctttctgttgttggaggagtttttgtccttgcaggcatcaccaagttgcttccttagctgtaaacatcttaggaccatgggctgtgactggcaaggagcgggccttgctagtttcaagatagagttggttttaaaaagatgttgccctggctctcctgggctcttgcttccctgacagcaggagtctcttctgcattttgtatactgcagctatctagaatctgcacactggaagaacgtaagtgtacaggaaccaggaagcttggagaggctgctggcctcctggtcttcctgtaggtactaaggaggcctcacccttctgggatccagggtctctccctcaaggcttgggttagggacattaacatctaaggaacactatccaccgcaggaggctgtagctctgacgtgcccaagaggaaagccctgacctacagtggcggccgctctgttctaggatgtggatggcacagactggtcagagagagccagaaggttctgggggtgagctgcagctgttggcccaggggtaaatgttgggttctacccagtgccatgttaagaccaagggaaagacatggtggacgggtgtggctctagtgaacgggatttccaccttagattctgttccccttgagccatttattgagcacctgctgtgtgccatgccctgtgcggggctgtttgtcctcctgctggggttgtgtttcttgggggacatagctctggccgcagagggattaatcatgcctgaaggacctgggaggcctccaggaagtgtggccactggacacagtctaattcccttctcttccgagaccttcacgcttgcctcctgcggtcctgcccaggctacaaagttgacattgtctcctaaacagtttctttggtgctaaattgtcaggttgcaaaagctatgagggaataaacgggtggtgcatggagctggtgtcactcattgatcaacgtgctattatacgctggggtacaaagggtgcccggtgacccttccgaatctattatttactcgaaagcagtgaccacatccacacacccagggtgacacagggtgtgtgacgaggcccacagatacatgccgatttgcaggggcacctgcactgggtctggggagccatcatcctccacaggagacagcgaccacctgtggatttttgaaagaaaggagtggcatggatttccccgagcgccacctctcattcctcctctcccattcatggtcacagcctgtgtttgagagaaggctgtccagctggggccatctgggtgtggggcaggatgaagctcacgtgccagtgtggaatcgacaccctcattctctttagtatcatgcagtccccacagcgacttctgcttcaggctagttccgtaacccgggaaattttgaggatggaaaagggcagggacaggagcggtcaggagtggctcagccctgagcccagggttttgcccagccgccttccgtctaggctgtccctccatccgcatccaagaagcggcatgcggacatctgtgactgtggaggatgcccatgcccctgtggggacaggaatccctctcctctacacagaggccctgagctgcttcctggggtcaggacacacctgcacaagttgaaaggccggctcttgttctttgaacaatagaaccaggaataattaatcatcggatatagttgggcagagaaactgcttataatttacaattaattaaccttccccttaaaaaaaaaactggagacctaatttcctgtctgatccacattgtttttgatatccattatttttcaatgtgtttttgttgagattaggaaatatttgtgcagaatatctcagtccgattaaggtgacaattgctcaggattttcgttgaaactgtgtattataatgaggctttctgcagcgcatcataaaaggaaaaattctttccatcatttaatttaaaactaaagccagactatgtaaaaaatattacatgtaattttaaggctataactttgttttgtggcgaaaaaattctaactttcagatgaggacaaaataaggtcagcattttttaaaacccttggaaaatccaaactctggtaaatctcagctggtagttaagtcactgtctaattaggattctaatttcacaatctcaattatttttaactttctggtgaatattaacagaatgatcagttttggcaaaatactaggaagaaaaatgtaaactaaggaaattaaaaatgatgatagggttcacaatccatattacctaaaacactcaaccagtcactgtatagatgagtaataacaaagtcagtctcagtataattgtgaacattccttttgaaattgaacatgtgaagacacatgcacacgtatgtttattgcagcactatttacaatagcaaagactcggaaccaacccaaatgctcatcaatgatagactggatacaggaaatgtggcacatatacaccatggaatactatgcagccataaaaaagaatgagttcatgtcctttgcagggacatggatgaagctggaaaccatcatcctcagcaaacaaacacaggaacagaaaaccaaacactgcatattctcactcgtaagtgggagttgaacaatgagaacacatggacccagggaggggaacatcatacactagggcctgtctgtgggtgggcggaaagaagagggagagcattaggacaaatacctaatgcatgcagggcttaaaacctagatgacgggttgatagatgcagcaaaccaccacggcacatgtatacctatgtaacaaacctgcacgttctgcacatgtatcccagaacttaaagtaaaataaattaaaaaaaaaaaaaaaagaaactgaacacatgtcaggagctgaatttaaaacaatgttttggtcagtaccaggacacgaatgacaggctgcctgcctgtccgaccctgggccttatagacagtgtcacttgataggatgttttgagacccggacatccccagcagcccagcatgcacaggctcagagcccacaggtgcacactggggttgtcatgggagacaggtgaggagactggagacaggcaggtgcagaaatgtctctgtcagtatttcccatgggttatctctcacttactagctgtgtgagcttcggcacattatttaaactttttttcccttagttcccttaagggaaaaaataaagataataatagtgtctacctggagtgattgcgttgaggattaaatgagttaacccatctacgcagttagagccggcttggcgtgtgctgggtgctcaccgactgctgggtgtggccatcaccatcaccacccttctaagaggacttacccggaagctgccaagtcttactggaattcaataagaaaacttacttccaaaaataaaaataaaagccacacacacattttccctgtaaatcttgataggaagaaggaaaaggtcaggatgttgccgagcccttgggttggaagaggtcggagtggggcgcgtcccaggtcgggaatgttaggacaaggtggcctctgtcttcatcgtgtgtcttgggtcccccttcgtaatgatactgtcctcaccacgtctttttattatgaaaaggaagagtggcgaggacttgagtgggactgttgggttgttgtgttgcagaggaaatatgctttttgcagagggcttagaaaacgtgcagtgaaaaaaacaatgagccttcttggccccaaggcctgtggctgctggcaggacagcggtcatctgctccaaccccctagggaagagtgagccgtttgctctttttctcttctccaacttcccagaacaatgagggtgatgaatgaagaggtttcccatgatagtgaggtaactctgtcagtagaagccctgagatgtccagaggcctgggctcaccaggccccaggtcagaaggctcggcagcgccccacacttggctttcggatcatctcgtgctgggctcatcttcccttgcggcttcctctgctccctcagttgggcccctgcctatacgtctccaggcccccgaggctggcatgcagccccatggtcataatcaatgttttatgacacctgcagactacaggcaatagtagacgattttacggataatagttaatagagctctcacatcgacaacccaatgagggcagcctgcttctatccctgtttacagaggaggaaactgaggcacccaggggctgggtcacttgcccatggtcacagctggtagggggcagggccggatttcagcctcgaaagtctagctcctgaggccatgctgctgcctgccacccatcccacctccttaaggtgctgtgttcccaccacttcctaatcctcaatctcctctcccctccccatccaggaagcctgctaggatggtccttgtccatattctccttcctggcctccacctgatgatagcttgttgtgatacttgattcagctcgcgagatattcctagaacaacgagagaaaaatgaaggcgcattaggcccgccacaatcaaagctgtcgttcccttctccatccctcacggcccccgaggaacaggccagcccctttccacccgtcacatcccctgaagaacaggccagccccttctccatcctttatatctgctgaggaacaagccagccccttctccatccctcacggcccctgaggaacaggccagccccttcttcatctttcacggcccctgaggaacaggccagcctctttccatccctcacggcccctgaagaactggccagccctttctccatccctcaggtctcctgaggaacaggccagccccttctccatccctcacgtaccctgaggaacttgccagccccttctccatccctcacgttccctgaggaactgggcagccccttctccatccctcacatcccctgaggaactgggcagccccttctccatccctcacatcctctgaggaactggccagcctcttctcctttccaatgggtgtgcaggtccctccctgcgaggccctgcaagtgtctgcaaatgcaccagctgatgcccactgcccagtgggtgttcagtgcactgaaaagttccctctcctcccccactgcagccctcctgcctcacttggagacaatgcagaaccaagatgggatcaatagtcattgatttctcttggtcttgaatgatttttacacaagtcattttgcaataagagggccttcgtacggtgcctgtctgcactgagggcgtgggatgacagccatttttgctcagatttctgcttcctgatccacggtaagatgtttcctccctagctggggagatcctcatggctgaagacagtgtcctggcctcttatctatcctctggagagtctgcctcacagcactggcatagtcgtggtgagcgcaggcactaggatggaaaatctccggcacacgggaggggcacgttcaacaagagttcaggataatccctgttaccacaggggtgttcaggccttcacaggttggcagagggcccaagtgtcatctgctggtcacctcagctctgtgaggaagaaggggtgcagaccaggaagtggctcagggaggtcggaggccagcccaaggagggggtgcctgagtggccccaaccaagtgccgcgctctcccccccgccctctccccgccgccctctcccgccacgcacggcctcctggcagctctgccttttgggcacacgcaccttccgtcttcactgaatccactcccccttcaggtgggcaaacactgcctcttgcagacatgttcttgcctgtgccctgtcctgggaactgtagttggcagttactttgaagagcttaggaaacagcatggagttctgtcaggtggcagacattctagaatctctctaacaaggctgagtcggtgtgtcagtcagggccgggaaacaggccgtggagctgcctcagaaggcccgcaagttcatggccacacctggttctgtgtaggaccacatgccttgtatgtcccattacattgaaatcttttcagactgtgatgaaggaaatacagattttttttttttttttgagacagagtctcgctctgttgcccaggctggagtgcagtggctcaatctcgactcactgaaatcttcacctcccaggttcaagcgattctcctgcctcagcctcctgagtagctgggattacaggcatgcaccgccacgtccagctaatttttgtatttttagtagagacggggtttcaccatgttgaccaggctggtctcaaactcctgaccttaagtgatctgctctcctcagcctcccaaagtgctgagattacaggtgtgagccactgcacctggccaaaatacagattattttaaaaaagacattgaatgtttagaactgaattaaactgataactgcaggtttttgtttgtttgtttgtttgttttgttttgtttgtaagaagggatgcttatattcacagagtttgaaaaacaagtgacctaagccaacccctcattttacagtagaagaaaggcagcccagagaggtgggaccagagctggagcctgggtcccaccgcctgtttgcgtccttcccgtgagagcacgcagcctctataagcagcaggtgggacccaggcgtttgtctatggattttcctctcaaagttgctcttctctttactagggcagatcccaattttgaggggcctagagtctatgaaatttgggggatcctctttagaaaaaggacagaagattgtgaatggaagcaaaggcccatgaaggggagaagctctgagacccagcttctccagccccctggtgcgaattcacccctcgccaccaccccgcagggatgctcccattccacagcaatttcccgcagactctccagaagtgtgcactccggctcactgcttccccagtcttcacatgtttgcttgtcacttgattatcctccccgaagaggagccacttgtactttaaatgcctccttcacatcagcaggcaattaacagtagggaagggagaaggagggtgagcagtgaggcttctcaatcacacaactcaagagcacggggacgttctcccaggagcagcctgtctcttgtgcctaaagcacaaggggcagcggcaataggacggaaggggaccacccacgggctggactctcgaggccaggcagaggccactgtgcggtctttccttccgcttccctctccctgagccttatgcaaatccggctcttagcacagcctttagctcttgtctgaattccaggggaggcccaagatgggaccccctacttcaaaaataagcttgaattcaaacctccagcattgttccacagtgcgcaggccagaagacatccattctgttcctccaattccctgtaaggcccctctctgtgtccagccagatagcgtgtctccaatccatggggttgcagaaggggctcgctgcctgtgcactagatgccaatacggtgacaccaggattttcagaaaagaaaagctttatattaaaagtctattcccagctgggcgtggtggctcatggccttgggaggccaaggagggcggatcacgaggtcaggagttcaagaccatccaggccaatatggtgaaaccccatctctactaaaaatataaaaaattagctgggcatggtggtgcacacctgtagtcccagctactcgggaggccgaggcagaagaatcacttgaacccagcaggcagaggttgcagtgagcagaaatcatgccattgcactccagcctaggtgacagagcgagattctgtctcaaaacaaaaaaaagtctattcccaaggagacaggcatccagctcaactctgcctccctgtgctggcttcaaggcagtaattttatttttaaaggaaaaggattcagcaggcggattctgggattagcaggtgattggtggaaggaacggggaggtttggaaagtccttcagcacacacaattatttcttcacgattactcatgggctgtgtgtgcaaattcaggggggtggggtggaggaaattcagtccatgacatcagcaagctcattctgcacagaccccagttgaccaacttggttctgacagacttcagccagttctcttatctcggggcggagggagcgtcagtgtttcagcaggttgtttctattcttgtctgccattctgcgagctcaagaacttctgttagccattcgtttctttaactctttgaggcattgtttcattattaggatgcttgcttatttcttgtctcttgagcaactgagtgggtggatgacccagtcgattaacaaatgagtgagaaacgagaacatccttgccacactgggacctgtttgagcgtgaggcaggtgagcagaagacatcaggcccagaagttctggaagctccctcaggtgcccacaacacaaatgaagaggaaagagagaagacaaaacaaaaagaagggtaaaggagcctggcatactggctcagccttcctctttcaaaacttttgtttttttttttttgagacagtcttgctgtgtcgcccaggcttgagtgcaatggtgcaatctcgactcactgcaacctccgcttccctggttcaagcgattctcctgcctcagcctcccggatagctgggactacaggcgcctgccaccatgcccggctaatttttgtatttttagtagagacagggtttcaccatgttgaccaggctggtctcaaactcttgaccttaagtgatccacccaccttggcctcccgaagtgctgagattataggtgtgagccaccgcacccagctcaaaacttttttgaaactaaatttgagctcagcgatctaaaatacaatggcataaaactgcaagtctataaactgggcatagctctttcctcctctgctctgcaccaactggggtgaccagaagggactgaacagtctaggggcaggtcttgctcactcacgcgtccatggctgacgctggctgctagatgaggcctgctctgtgtcagccaggacaccaaatgtggcctctccatctgaccagggcttgctcaccacatagaaggtggtgttcagagtgagtgacccaagcaagagagagccaggggaaagccataccaccctgtgtgaggccgttcttgcattgcgataaagaaatccccgagactgggtaatttagaaagaaaagaggtttaattggctcccagttctgcagactgtgcaggaagcatagaggcatctgcttctggagaggcctcaggaagcttccagtcacggcagaaggccaatggggagcaggtgcatcacgtggtgggagcaggagtgagagggagtgagtaggggtgagggaggcaccacacttttttttttcaaggttttattttatttttattttttattatactttaagttctagggtttgttacataggtatacatgtgccatgttggtgtgctgcacccattaactcgtcatttacattaggtatatctcctaatgctgtcatccccttcccccaccccatgacaggccctggtgtgtgatgttccccaccctgtgtccaagtgtcctcattgttcaattcccacctatgagtgagaacatgcagtgtttggttttctgtccttgcgatagtttgctcagaatgatggtttccagcttcatccatgtcccaaacagtcagatctcatgagaagccgctcactatcatgaggacagcacggagtagatggtgctaaaccatttgtgagaaatccaaccccatgattcagtggctcccacctggccccgactctagtatcagaatgacaattcaacatgagattcagacagggacacacatctgaactataacacaccctttatgacctagtctcacaagccatcactttctgccacattctcttcattcaaaacactgccctggttcaaggagcaaagaatcacctcttctttggggagtctcacgccctggaagtagcactgaggctagttttggaaaatacagtgtgccacactcaccaaggcgtcagtctctgtgaagtaaattatactgagacatcagtgacttcatagagaaagggcatgaataacccctaaccacaaataatggcaagaagtatccatggaggcatcttgggaagaggcttctgatgttccatgcctactccaggcagctgtgtgccccacggccttccgcagtagttgaattcgcagactgagcatggcattggacccgatggccttgcttccactgagcctctgcacaacactggccttgggaaagaccacaaaatagtaaccggcagggctcagtagacccggaagcttagaacctgtagaaaagagaaggcttcctgtgatcctcctgcttcaagcaagggctccgccatctctcctgcagataaaaactcaggaacattttatgttctgcttttggagggagtttataactttacattctgtcttaaagaaaacacaagttttgaattctgggataccgagttcctaaaagaaaatccaggcaacaggaggctcccaatgtgtccaacctgcctccgatggtgcaatgaaacagcaagtactaagaaaatcaccaaagtgtggaagtggcaggggactgctttaacagcaagagaaggagaaatcttagtcgtgctagttccacatcgtggctgcctttgacttctggccatttagaaatggctctgctgccagctgggtgcggtggctcacgcctgtaatcccagcactttgggaggcccaggcgggtggatcacccgaggtcaggagtttgagaccagcctggccaacatggtgaaaccccgtctctactaaaaatacagaaattagctgggtgtggtggcgggtgcctgtaatcctagctactcagaaggctgaggcaggagaatcacttgaacctgggaggcagaggttgcagtgagccgagattgtgccactgcactccagcctggatgatagatcgagactccatctcaaaaaaaggaaggaaggaaggaaggagagagagagagagagagagaaagaaagaaagggaaagggagaaaagaaaggaaagaaagaaaagaaaaatggcttgctgccgagggaagagagagagatgaaataaatatgtctcctcaccctcttcctacccctgagctaggcacagttcgcttgtccatatgatgagatatagatgcgagggtttagctgtggattccacagcctccatcagcagcctgcgtgctcctaataaaaatgcatcctagcctcccaccttggcctttcctcacccagaaaaacaaggccagtgaggtcctaaagagcctattctgcaggagcgcatgtgagaagaactcttagagaaacagcagcaagttcaatttccccagagaaccctaaagcctcctatttcccttcagcctcacgtctgtgctccctaagctggctttggatttctctttagctggacttcattggcaggtgcggcaggagggtgtggggagccccctagatacaactgccaaggagactttaagtctgcctcactcccggcctccctttttgtactttctagaactcctcttggtgccctctctacccacacccctgtgccctttctgctgtgcactcaccttgcacagacctgtggatttggatgccccacctccatctgcaccacacctgagctctgtgggcgctcttcacctctatgccctgggcactgcatcttaggccttggatgtcatttggaagcagagtctctcttccttgttaaagcattgctgggatacagaggggagagctgtcctttcccgggcttgggtcctttgtagaagctaaaatggcacctgttgggcagctctgtcttcatcttgtgaatggaattgaccactctcgctcggtggatttgctagaggagcttcatctgatgttatactaaggacctcaagaattcaccttattcttgacctgttaggtccatgaaagtgttactgtaacctgcgtggccaatgagatctccactccagccagcaagaagtgggaaagagaggcggtggtcataccctttctccttaaaggcggaagacaggtgtcactcatcaccttttctcaacccagcagcaggaactcagcacacacccaacctcacatctggggagtctgggaaaggtctttatcctgggaggccgtgtgcccacctacaagccattggttcttttactaaaaagagaagggagtgtgggtgttggaggacaatgagcaggttctgccattccaccttccacaagaggcttctctaatttcctccaataagaaagaggcctctctgtattcccagaccccatagttctttctggtttctaccttgcccactttccccgagttgcaagttgcagttctccttctgtttactgtattacaaacttccaagctttgtctctactttactataccctagggaattgtgtgtactgagtactcagtctttgttcaataaggttaatttccctgaacctccaattcctcagttgtaaaggggcacttaatataagcttgtaggtgcatcacattctctccagagagagaactcactcctaagaaagcagcaccaaaccattcatgagagatccacccccataacccagacacctcccactagtccccacctcccaacacctccacattgggaattagatttcaacatgagctttagtggggacaaacaaaccacttccaaaccacagcacacatatgaatgagatcattcggcattcgtctttctgtttctggtttatttcacttagcacaagtcctccaggtttatctactatgttgcaaatgccaggatttcctctcttctagctagtcattgttaaccagaatgtgcaccaaactcacctgaagaggttttgcagaaaaggagcctgtatcctcctcactgcccccaccaaataccagttctcctgcctgaagtgcagcctcagcatctgtataagcagcacacacatgcgcacaacagtccaatggagtcccctgcaaacctacctaaacctcactaggcaaataggaaataatagtggtggtcacctcttcatctgtcaaacaacctggaaaatgtgaagattcctcttcattgttgcattggcctttattaccttgagcacaaagggatttttctcctactggatatgaccttaatgctgcttggcaggaatgaataacactccagataatggcactggcttcttcaaggtatagtgacaaaaaatgaaaaatacccagcccagatcctacctggggctgaagctctggatacaacttttgccatcttcaagagagaagcagccattgaacaccgactgtccccggatgtatctttcttttctgatgctaaaatagccccccagcaggacagggaaggtgaagaaaagatgtattctctagttttcccaagttaattatacttgctcagaaagccaagtgattcattttgttccaaggcaggcgtccatgcaattaatttcgttgatgaaataggttttcttctgcaaaactctgcttctaaactgcatttggtgcatggcatttaagccaactgcctcattaagctggaatcctgcagaaaaatgtttgcagaatagggacatttggaattaatgctaaaatgtcaaggtttcttctgcccagcacttttttaccccttagtttcttatacttcattatcacattaatgagcaactaacgtacaggaaaataaaaatggcaaggagcgatgtgttcaaggacacctagggaaaataaactaaagctgccctagttttgtacggctggcattttggcgtggcacaggttcttcgcatgtgccactgtctcgatgtggaatgacattcagaggaactaccctctgccatcacacacaccagatacctgtcatccctgaacccgatgacccaatggtcgctaagttcccttcttttattttattttatttttttgagacctagtctcactctgtcacccaggctggagtacggtggcaagatctcggctcaccgcaacctcccaggttcaagtaatgattctcctgcctcagcctcccgagtagctgggattacaggtgtgcgcccagctaatttttgtatttttagtacagacagggtttcaccgtgttgaccagaatggtctcgaactcctgacctcaagtgatccacccacctcagcctcccaaagtgctgagattaaaggcgtgtctctaagtttccttctaaccgttacatttggtaacctgtagtgatggttttgttctacctcccagttctctgaagagtgaattgagcttcatggaaacactctggcatttgctgataagatcgatggaaatagagtattctcagcccagccttgtggccagccttcacccacatttttttcagtctcttgtcccaacaagcatgacccactttggactgtgctggtcagaaccaagcagcagcatttcctttaggtcagagagcgagtctagaaatgagatacaaacaaccctgggtggaaatgaggggtgacccttgcccccccttgcctagtggcctcttgtggaacctacggggtaggaatgaaagtggcctgatgttgcacgtggccgatgatttatcatccctctggtctcagaaaagattgctttgggttcaaaggaaagaaagaaatgagttgtctcttcgggggttttgttgttattgttgtttgtttgtttctgtccaaagctgcttcatttttaaagctcttgttgcagccagccgtttttctgttttggattttcccgagtcggctgtgaattaatgtcccgtggaaaccactgcagggctcctctgctgatttctgtgggctctgcaccttctcgctctgccctgtgaattctgctcactcccagggactctactccagccccattggcccctttcttgtggccctgcagcgcagacgtgattgagcacaatcacccacaaattgcattgcaaatggtgcctattttttccagcagaccatctgctggagtcaattactcaccattccaagcgagcagcctgggcagatctggtgactctgcataaagtcacttctgagtcacctcatcccaaactcgcacctgaacgtccacctcctggctgccaaagcgactggaaaattacagaccctggaggtctggcttccttcctttgtcttctcctcactgacctccacaggcctctgagcttctattggcactgccaaagcttctgaggctgtgagacagacgcagaggggaaggggatgctagaggcggctgttgtgcccctagctttgcagatcgggactcaagaacacacagcaggactggggctcaagtccagtgcaccagggctcctgaattcatttttccctgagcactgctctccatactccgggatgcaccagagtacaggaggtcaaacccgccacagggtttgtatttcaggagactctactgagatgttcaggagtctgcagcagactcggcattgccttcggtggggggctgtctgctggggagtctgaccaaggcaagatgaggaagactcacgtgacaggggagcgaggctcaatgagctgcagcatccccatcagtgccatgccagatgccacagacatctgggcagggaggggcagggcatgcaggcacatcacaccctcagccccactgcccttagagcctggctcctgctcccaccccaggaggatcatgggcagcgtgcctgctgcaggcctctgggcttggctgtgaaatgccaccatggatgacactgacctggcgctaagccccccttcatgaaccctcctcccggccagctggtctcctcctggtgcctcccgcagaacctgggaggctgttgatgtgggctgcttcttccctgtctgggactgtgccctcctgtgggcagtcagcccttggcttccttccaatttacattgttctgttgcatttgatgccctcgttttgtttttgcaatgtgttttcaggcttcttaatcacctttctacactacaggtacatagagcagatttatggtacgcacctaataatagcgagttgaatgggactcatgaattatattaatcattattttagaagcaaatctagagggaattagtttacactatatatagacccagtacaagacagaaccccttgacctaagagctgttcacaatgaaatgggttctctgactggttacccttgggaagtgtattctcccaacgtgttgaaaaaaacgctgtagaaatttcccctctagaatagatatcacaccctacaaaactcatctgtcgttaaaacactaaccaggacactgatgggctaggaaggaataatgggtgtttctggttgaagcccaaaagaatcagtctttcatttcagtccttctgaagatggatccattttggttttctgccatgcatagtgagcttgtacccttcttgtaagaagccacacagagtgagcttgcaccctttgtgtgctgcaaggagcatgctgggcctttggactcattatctgaggagggagctctgtgtgtgcgtaaatccctggtctgcttttgggcgactcagcctctgccagagttcactttctcatttggttccgtctgcatgggacacgcttccatgtgaatttactttctccagtgctgtttttcaaatcatattaagtaataatcaacaatagtacaatcatagttcaactcaaaaggacgtgttgggctcatagtgctcaaatgtgtgcaaagaaaaaaaaagtgtttccagacgattagcatctgtttgattgagctttggttaatggggttttcctgtgctggacttagtcatcagcatcagacatttcttgagcccccatggaatggaagcatgtgcagaacacagtgaaggttcctcaaaggttgtagcagataaggggctctgcagggactcgtttctttcctggccacctcatgttcctgctggtgcagctccaatttccactcacttgttactattcacatttctctactctgttttcccttagaggagattttgaagacacacatcgcacactggtggtctccggatggcacgagactcgcctacgccgccatcaatgattcccgtgtccccatcatggagctcccaacttacaccggctccatctaccccaccgtgaagccctaccactatcccaaggtaggcaaagggacaccgcacagcaaattctttatattattcatgaacaccccaaccctgctcactcagtgtgcagacgtgatcatcagacatgtgtatgagcaaagcagttaacacaagaaagactaatcatgtctcattacattgcattacattcccgcctctgttgagctgagtcattggcaggtttacttcttttaggtaaccgaactaatgttcatcacctgactcagcttcactgaaccaaaacacacagggtacctcccctcaccactccccagtgatgaaggtgcacctgccctctctcacgcatcttatttctactttgagtttggcctctgggaaggcagaaagacttccatctgcccctggtcccctgggtctgggcaaggctgttttgttcatggtcactgctacgggctaaatgtttgtgtccttgccaaattcatacattaaaatcctaacccccaaggtgatggtattaggagggagatcactgggaggtgacaagacatggagggcagagccttcatgattgggattagtgcccttatgtatttgtctattttcatgctgctgattaagacatacccaagactcagcaattgagaaaagaaagatttattggacttacagttccacgtggctggggaggcctcacgatcatgtcagaaggtgaaaggcacgtcttacatggcggcagacaagaggagagagtttgtgccgggaaactcacctttttaaaaccatcagatcttgtgagacttattcactatcaggagaacagcatgggaaagacctgctcccatgattcaattacctcccaccaggtccctccctcatcttgggaattcaagatgagatttgggtggggacacagtcaaaccatatcaccttataaaagagaccccagagagacccctctctgattccaccatgtgaccatacagcaagaaagcgtcctctgtgaaccagaaattgggccctcgccagatactgaatcagccagcaccttgatcttggacttccagtccccagagctgtgagagatacattgctattgtttgtgagccagtcagtttatggtgttttgttacagcagcctagaggggccaagacagtcatgttctgacccaatgagccagtagaacagcaagtgtccagtggctgggagggaatattggggggaacagggatatccaaatctcactttattaccaaatcaaagcatcccagtgtgagtggagggcctgatactaaaacctccacagccactcagctggagagaagccagtgcccgagtatggacacagctcccatggacacatagagtctgccatgctggcttctggcttcactaggcttctccaagacccctgggcttggtggaggtgagcagtttcctgcctgcaccctgcctggtgactggaggctcacttcctgccatgagctgcctctgccagggggcatttaaacctcagcatcctagcccaccagagagctctgaaagctgatggtatgtgcctgctctgccataatcatccccacagaccagctggcttacagtttgcagcaagaggagtgataacttataaggcagatatatgaggccagtgaggttcccagagtcacagcctagagaaaggaaacacctggtgtcttagtcagttccagctgccacaatgaaataacacagacctaggcagcttaaacagcaggaatttctttctcacagttttggcagctggaagtccaagattagggttccggctgatttggttcctggtgagggctctcttcctggcttgcagacagccgccttctcgccatgtcttcacatgaaggggcaagagagggctctggtgtctcttcctctccttttgtggacatggatctcatcacaagggtgccaccctcatgaccttgtctaacctcaatcacctcccaaaggtcttacttccaaatagcatcacactgggggttagggctgcaccgtatgaattgaggaacttgttccatccatacacctggtaatacaggctcctttcaacagcctttgatcagcatggccaacatctaagagagccccagaaggaagaagaatgagacccttatggccacagccttcctttctgccttttccaattctgagagcatctggatgttaacatggcatggatttgccttcgacagaattatttcactcctttttcagctaaccttgattggtcttagtctgtagcatgtggaagggtccagcattttagttggaagcataattaaatagagaaaagtgtatgggactgatgctagttccttctaacccttctacatttcttaccagctgttcacagccaccccacccgccagaagagctggtggctgtctgaccttcatccaacccagagatgaatggttcccatggttatctttttgtgggagtttccccagtctaggagtgataacctggaatccagtagggtgcccttgattttacagtgaactctcagaaggtgctctgaagctgggattatgaaatcccagattactcaagatttggggtttcatattttaatagaaaaccaacattctggctgacagaattcagatgctccttgccccattcccacccactcctaaatcagaggcatgaataggcaagcctgcctgacatgccctgtcgtgggcctgatagcctctgtaaacctgaacatcttctgcagggtggaagtgagaacatcagacaacaccccgaagtccccctaaagaggaagccccacatctctccccagacccatacttgtcccccagagagtggggaacagggaagcagaatagtgccccagttcctttttgaaggacttaatctctccccatgctgagcatggccaccgctcctcaatgtccatcatttgctcacctccaactctccccttcctggcatccaatccatcttttctcccccactcctcttctcgtcttctcttttaagcaaggggctcagtactcacttgacattgccaaaccggggagttgggtggaatgggaagcggatgggattctagaaaagcaagaatcagcccacttagccctttgtccttttgaaaccctacacatgaaccatttgttctccacattaattctgctccttaatatggagctccagtgtcctggagtcccacctcggaatctcccaggaaaggctttgcagagctgaagttcactcttgtataaggctgcttgttcatgtctctgcccctttttaatccccaggctggaagtgagaaccccagcatttccctacacgttattggcttaaatggacccacccatgatctggagatgatgccgcctgatgatccacggatgaggtttgcttccttctattatgttaccaaaaaaaaaaaaaaactaagatgaatgttcaatgtgcatggtctcttctggatcagatttatcttacaacaagtttaaacatccaagaaaaaggtacctttcctaaagatttcctcactgctttatgattccattttctaggaaaagaataccattcaccaagtactattattttttaccttaggtcagatgcaggttatcctcctgagagctgggctcctctgggaggggcatggctgggccccaggcctgcctcagggggacaccagaggaaatgatgcggtcttcccaagacaatccatggagtctgaccttccataaatggtgctctgtatttagagcattttttagagcatggagcaatttgccagtggcaaattctattctaataaagccacatctcccagttggtaaggtcgcaaccctgtggaaggtattaacaatgttattgagttattattattagcatctgattgtggtcgcttttttctaaatcaaaacaactgatttaggatcgaatgtagtgatctgaatatcagtttagtattttccccaaattcaagcagcgtggggaatgattatacttccagagtccagctataacatcatcagccttctctctgttaaggatattgatgagagactcaaaaagaggaggggattttaggggtgccaggacccacccaagtatagattctgaaatttcatgaatggcactatttaaactaagaataactcattctgaggctcagcaaagacccaacccatattttgctatacctccagcctgggcctttattattccattcaaagctccatattactagtagcttctggcagcttctggaaagggcaggaatcgaggcctcaggtctagctcggggatggatgctccagcacctggtgactctggacctctctgaatgatgtgctggtctcctgcagtggctccagtgccacctttgccccacaccctgagctcctgcacagaagcccgaggcctctgcagaattctactgcgattccttcccctcatctttcttcagtgaaacttataatgttgtaagatccccaagtggatggatgaagcccagaagcccagtgctctaggaagcgtgaggcactgcctgcccctctcagccctgcatgggtcttctccccaacataggagggcctgtggctctagaggtttaatgaacctggcccccagcagctggtcccagggacaactggtcactggggtatcagcccaaggtgtgcgctggtttggagagttgaattgatttggctggtgatatttttgctgagatttaaaaaaaaaagttcagatgattgctttggcttttctcctaaagttccatatattttattgttttcctttcagcccccatccctgccaagcctcctggggcctggtccagcaaactcactgaattaatatggaaagtcacctggaaaatttcagccatctgtttgagttaattgaaaatctcgtttagtcaatttggtgatgctgtttccacaggcttgattagcttcaaggacaatgaaaaattagcgtcagccaggacttgaagcctggatgctgggcttcaggttttctggttgctctcatttcctaagctcaatgcaataatgcattttatatgcaatgtaaatttgtagcatgtaaatgtcacactttctcatactgcttctctatcacacatctttgagagtttttaaaagtccacacagatatatcagaaatcccaggctcaatgtagagcagatgtttagtatttgccagccatttgcctgagcactgggaatttggtggcaaatgaaccatggagttcacagtgtggaggggaacctggatcctgaagaagtcattactagcaagtaaatccctgcaggtgtgagaagggctgtggaaacgtgtggaagaggaggccacctggtctggagggtggcagtgtcacggctgaggtcagagtttctgcatgtccatgctactgacatttggggctcagcaattcagtgctgtagggggcagtcctgtgtgccgtagagcactaggcagcatccctggccttacacattagatgctgtcatatctgccttttccccctccagttgtgaccatcacaaatgtctccagcattgcccagtgtccccagattgaggactactggtttcaagtgaaggttctctagccaactgcctgggttcgagttctggctctgtggactctgtcaagttactcagcctccctgcttcagtttcctcatctgtaaaatggagataattttaataagaaacatgtttactctcgtggacagttgtgaaagttagatgagataaggcaaggatcatagggctggttcctccaatcgttccatcttgtggctatacataccccttgtatgtggacaactctcccctgtgtacctcaacctggcctgggtcaggactctaggttcaaaaagccaaccacccaaccagcatttctactgggagtggtcaccatataatttttaaatggtcaaattgtgattctcagacaaaatcaatcaacatgtgtccaagactttattaaactcattaattaataagggaaccagtgagctcttaaaaagaggccatagaaccatcgagaagctagttgtatagaggcaattgaacaaggacatcctagggtgagtctgccgggttactcagccatccgggagagacgcctaccccagcagggttgagaccgcccctgcaattggaaatcaagcccagcatgtccctggagaagggcccagtgatcccacctgcctctttaccaccttcagatccatttgctgacactgtctacacagcatctcaggccgaacccggtcaaagccaacctcccactctccttgtctacacctgctccctgcagtctccccatcatggtccagggcaactccaccttccaggatccccggcctcctttacgtccctctgtgctggggaccctccttggcaggtgcctggcatcagcctgcaaccccccgccgttccccactcctccctggcctggcccaccagcactgccccctcctgccccacccactgctgaccccacacagcagccagagtaaccctttaaatgacatcaggccacgtacccgctgctcccagacatctagtggcttctatttctctccaagtaaaggccagacttcctacagtggcctcagaagcccccatgatagatgatagatagatagatagatagatagatagatagataaacagatacatagatagatagatagatgattgatagacagatagatagataggccatgcaccctttctatcccccctcacatcggctgggtcactcccatacgaggatctgcacagaggctcccctctgcccagagagctcctccccacttaggtcctgatcaaatatatggttcccacagtgacttccctgataaccacatttcacatggcagccccaccccgcttccattttcttccttcaattcatcccagtggaatttttagatacttttttaaattgtttcattttcattttcccgcctgccacctagaacaggaagttgttgaggcagggacgttagttcctgtggggcgggccctggctccagttctgcagcagggctctggaaccttggctggatggatgtattgacttcaaatttagccggtaaaatcttatttgcatgggattcttgaagcttgagatatcttcagttgtgctggtacctttctaagaaccaaaacttacttgctatttagccatggatgacatcttgtcctctcaagcacaagatgctaaaggaactaactgaaactaagacacctcgtctgtggagggacacaaaaggaatgaaccctaagccatgcccctgagcacctaggaagggagacatgcagaggtttctggaagcctgcagtttatttcagcaggctagctcacgaaccaagaggaagggagaaagcagttcatgtatctgctatctaacctttatgccactcattttcaattattttttcctgtttgtttgcttgttaactagattgacttctccgatggttctcagatgcagggagagttaagtctgctctttcaaatctttgcattggcaagcacttactcatcatccatgtggcatgtgctgtgtgaggcccttgggtgattaagacgtgtggcctctcctaatgagagctcacattccaagaggcctggacagcttgtagccagagtctgcatggaagtgtggaaggagccacacctaggagcagaggtgccccttgtggggtgagtgggaagtgttcaggatggttttgcagatgtcagaaggatcccggggcaaaattggaggccctcttgggaaacggttctattaaagagaactaagagcggtgggcccagagtagagctcagccttccttgggctaatgcagggacccaggccttgttaagctgaacctgaccaggaaagaataaacactgtctatcctgtgggtggaaaaaaataaatgcaaatcgctgtgctgtggtttctatgctttcacacagaaacccagctgcactgataaaacaaatgcgcttgttttctgctggtttcctccggcctttcccgagcagttgagctgcgtgttgagttaagatgcggcagatagccagcacgatcattctgaagacatgttgccctgtgctgatatgtgctgttatttgcctccaaagatcctgtttggatgcagcgcagctgctcttctcctgattccctggcaagcagaggcggtaaagggctcccagaacccaagacacaaaaccaaccatgtccctgatgcacctgtgcgcagctgtgggggctcactcctccaccacccgcttccacggctcacgaaaggctcagaggcctctcactttcattttcttttgcttccatttatttgttttgatcccaagcaccaaggatttagatgctgtgcagctcctggcacagaagcatggtcggtccatgcaggcctctctcattttattgatttgctctttttcaactttagtccctactcccatgccctcgccacctcataggcacttatgtcgaatgcttagaggacctttgttcctctgtgtttttgtaaagcctgtattgttgcttgggtatgtgcgcgcttactttacatcaatggcattgtgatagagagccagataagctacaggatagaaacagatagagctccagacatagatgtctgtttctcctattttcctgtgagcaccatgtggagacctagcacacccatgtgtatttgaccaacccacggtttctaactgcacacagtgatgccagatgcccccagctcctgggcagcttacaacctcatggccttctctgcctccaggcttctccccaatatgcactgcccatgacacctccatgctgaccctgatgcgaaactcagccttctctctttccaatttatacaaaacatggtatgtgcacgagttttgggaaagctgagggtcatcagggccatgaaaacagcacagaacaatagagttctcatacctaatggcttgagcacccccccccaaaaaaaaccaccaccatcatcagtaccacctcttccccaaccttcaccacctatacaacctccaccaccaccacaccaccaccaccacaacctctacaacttccaacaccaccttcaccaccagctccaccaccatcaccaccaccacctctgtcacctccacaacctctacaacttccaacaccaccttcaccaccagctccaccaccatcaccaccaccacctctgtcacctccacaacctctacaacttccaaccttcaccacctgtacaacctccaccaccaccacctccacaacctttacaacttccaacactacaaccttcaccaccatcaccaccaccacctctgtcacctacacaacctctacaacttccaccaccagctctaccatcacctccgctaccaccatcacctccatcacctccacaacctccaccaccagcaccccaccatcacctccaccaccaccaccacaactacccccaccatcaccaccatcacctccatcacctccacaacctctaccaccaccaccacccccaccatcaccaccactatcaccgctatcaccaccacccccaccatcatctccactacctctaccacatccatcacccccacaacttctaccaccaccaggtccactgtcacctccaccacctccatcatctccacaacctctgctgccaccacccctatcaccacctccaccaccacccccactactatcaccaccacccccaccatcgcctccaccaccaccaccatcatcacttctacttccaccaccaccactgtcagctctcacttggtccctgttgctctccattcttaggtctcctctgcctccttccctatcataaacaagctctcctgcctcacatttacaatgtcaataacctgtcacatttacaatgacctgacttgcctatggttgcacttttaattagtagtagaaccaggacttgagcacgagtcttccgtcaccagagctattgctcagcattgtttaagagctgtcacgcctactgtatttccctttgtgcttgaactttcaggtggcacaaagctcatttggagggtttgctggcaaaatctctgttcttcctgctttcctccctcaggctgtggtccatctggatgttggggttgttcagacatcttcaggtgattcctaagtgtggccaaggcagagaagcccttctcagcagcagcattttacaaattatagctatgcccaacccccagttccaccccatccctgagtctgccatcttacctaaacatagtcctaacctctcttttgtctgggaagatatattattttatctgaatttgtgttccaattttttttggacgtggtctggatgtaaattacaatttcacaaatgtgctctgttcccctcacctgtagtcctatctctgttttcaccttgtgtgttaaagaaatcatctggctacctaaatactcaaatggattcatcttagggggcaccagttcaaggagattggctccagcagacagctttgtttacagccttgtgctttcagaatcagaccagggcagggtctttgttattcattagggtgagaagccattcccagtgactagggtaatggagaagctccagactagagaaatgccggatctttactgatgtgctgaaaaggaaattcacaaagttcctgttgatcatgggatcattaataaaaatgttcagtgctgtaggaggctggaaatctgagtcacagctgtcagaataataagtttctggtgaagaaagtacattttacattgtcatggcctgtgtttgaaagggcagctggattgttctgaagatgctgtaaatgcagggaatgattggttggttggcaggcttataatgagcaggagacatcagaaaaataaaatgggattctgcgtcgccatcctcatcaataaaacaccttagccatatcttccagctagcaaaacagtcttgacatctgaaattgtcagtaaaacactgaaacactggacaaggtttgccaaggcagagtcactgggctggtgagccagtgctggtaaactccaagggtgtaagtgacatccgcagtttcttcccgtggaccacaagtagcaaattcagtacatggatttcatggcatctgcaggaaaatgagacttggcaaaatttacctagcatcatgtttttaaatgtgttaacatgcattgaggcatgagcaaatattgaggaaacaggttgagtccatgggtgggtaggtgggtgatgaatagatggatgggtgatggttgggtgggtggagggatggattatgaatagataaatgcatgatggatgggtaaggggatagatagatgaataggtggatagatggataatgaatggatgggtggatgaatagatggatggttgatggatgagtgaatggatggatgatgggtggatggacggatagatggatgatgaatatatggatgggtggatggatggatgatggacagttggatgaattaatggatagagggatgatggatgaatgggtggatagatgaatggatggaaaaatggttgatggatatatggatgggtgagaggaatgaacagtagatggatggatggatggatggacagactgatggacaaatagatagatgggtgctgagtgtgtgaaaatgaatggctgggaaaaggacaacatggctttacccccaccactcctattcactgggtgtcttcatgttcacagcattaaattgttgaaaaaggatgccgcagtccctaaggcgcgttctctgtgaccccctctcacttcgttctccctcatcctgacagctggccctgcattatagccagcccttgagatggaagggacaggcagcatggtctattcctacatggaaagtgaaattatggaaacagacaccaaatagtaatttgtcttaagtcgtcacttttctgtgttgtagaaggcactctgccggcagatgtttttatgcaactgcatggctgcccgagagcatactcaaatgtggaactgtacactttagtagagcagcgcttggtatttagggtcgtttcagtttgctcagcggtgccctctattaaagcacatcatcttttaaaatgtcctctctcataacatttttgtacccctgctcaatccatgggataaacattgctaaaaaaataccagagttaactgtgggccctttatttcatgagataaaccagctttgttcccctcgccctttactgccacacaactgtcagaacatttgccaggatttgcaacacaaagaagtatcacagcacattaatccttgtgacggagacaatgctctattaatattttatggcaaacaaatggactaataaaaaattgatatgcttctcaccaggaagagtcactatattctgatttgaaggcacctttggcctaggactcatggaatgtaataacgtttcctcagccaggctgtgccattgcatgtgctcccccacgtaatccatggcagtccccaccctgtgctgaagttagtggcttgcccatctctgcaccgtccgcacctagaaccgtgtctcccacatgccaagccctgactagatgcgcttggatgcatcagtgcattggtaggcagatatagtgctttagaataaagagaaatttggtagcatttcttccagctatcttcgcttcctgttcatattttggtatcatgctctttttaaaatggaattttgattattaaaatatgaccatctattttctgtgattatcaaaatgcttcaatatctctcttcatcttggcagatagattattgcgtcttttagcactcagctccagccttatgttaaaaaatgattccacttcaaatcctattttctcctctcctttaactgctaccaaatttctctttattctgaagcactttacctgcctaccaatacatttacccattcaaagaatatttagtaagggcagatttggaaatggagatctatagttaaatagcgcttggagttattctcatgtggtcgcccactgccagacagaggatcgctcgtctccaatcagtagttctccactcgagctggcactggaatcacctagggccttgttaagccaggaagtgcttgtccccacccccagagtttcagattcagagggtctagggtgaggcttgggagtttgcatttctttttcttttttattattattattttttgagacagagcctcgctctgtcgcccaggttggagtgcagtggcatgatctcggctcactgcaacctccgcctcccgggttcaagcaattctcctgcctcagccccctgaatagctgggattataggcaactgccactaggcctggctaatttttgtatatttagtagagacggggttccaccatgctggccaggctggtctcgaactcccgacctcaggtgatccacccacctcggcctcccaaagtgctgggacatgcggttcctaacaccttcccaggggctgctggtacaggaaccacactgtcagaacctgacttgcctccttagagatgggggtagaggctgtttccaccacctgctttctcccctaattgcatggactttgcctgactttgccacaaaggcctcgcatccccatagctgtcctgctctctctgggtggcctgacctccctgggcgagggtgacaacactgcctgtgattgctgcgaaatcaggacagctcacacaggacgggcagggtcttctctcgtctctgcccgtgcttccttctaggcagcagtgccttctgagtacagtcatggtggtgccaatgatgtccctgtatgacacgagatgtgtcacccatgcagacaccaacaggtttacagggagcagcgcgggtcagtggcgtgtggcattattgcggctcgctgagcagtgggcagccattcccgcagcacaggattctgctctccctccacttccctttgtgaggcatggacgcctcccatcagtccaacctgttctcatgactgtgccttctgttgacgttgagtgttctggcattataacgttcctgtagagtctccctctgatcaatgcttccctttgtcccctcgagagacagtcttactcggggcatgggaatttgacaggcatctgcaggtcccacgccttgggacagaacacacatgagtagaagcacttccttctccttgctctttgtctcaaggagctccccgcctggccaacccaggactgtgaggaagaatggtaaggcctggaccttgtgagggaggaggcaggaaccagaagggctggaaaagggcacaggacaggctgacaaacatggctttcttggaggctatctcttcaagcctccaagaggagctttcttggagacagctcttctctgccctattttcatcattttctataggggcaaagacacctggggaactgcacaaggaaaggagagttttcggctccagcttgagccactgggactttcctgcttggagaaggttgctgcaaggggtcctgtgtgtttcattgcctgtgagcctcatgcccaacatggaacctcctgcatggcgtgaacagtgcacatccaagcttcgacagcagcctctggggagggaattgagctacaacttgcactgtgaacacgccattctcctgggacaagaggccctcataaggagagagacctaggacaagagtgagccagacctcggccccagctgtgcggacacttgcctgaggaaaaccttaccaagcccccacccttctgtaaaattcagaagtcacagaagcttatccaagcaaagcccgcagagagctcagcacaccagagcctttaacactcaagcacagttttctgagaaagaaacacttcactgttaaatcacagcaacgtacttgttccttcattttttttctaaaaggacaggaaaaaaatgtacactcagtgagctgatgtagattctagttacagggcagtctggtttttgcttggtgagaaagccagctcaagtattggtcactgttgagaatatacgtgagacccttacctgttccgagtttgtgaggtcagccaccaccatgcccgtcacaatcaggcaggggtgactctggagagctccatctaggctccctgaacaaaaagagcaagctctcaggtctgcagcagattctgtgtgtcctatcaccagctccctacctcagtccacagacccgtctaatctgaccttgccaccttcatgaagacttaatcattcccatccccttatcagatgaatgggtgggcattattaattaaatatcctactgcttctgtgccctttcctgccttcttttctttgaattaaacttatttcttgaggagcttgaaaaaaaatatcttattcttatgaacttggtctggttggaagcatctagagcggctgtgatcaggtgtgtggggaaggacatctccaccgtgtaccagtgagagctagccaataggttcagcctcattcagaggcactgaaatatttctccatgacaccgtgggtttatttattgttgttgttaagttttatttagttttaactttgcttttcttttttatcaaagtattgcatattagtgcttaaaaataaaataatatggaagagtctatagtgaaaaacaacagtctcttccctctccttctaacccatctcacccccagatggagatgacttttcactctttttacactttctcctgatatataccatcctatatggtaaatcactaagcaaaatgcacatttcactgtttttaaatgaattttagtcttatttattgtctttttatgatagacaagaattcggaacacttaccttcctacctattctaccccctccatttatatgtggattttattctctatgtcagttacctttttacatttaaatactattacaagtttgttcatgttacattaactacagagaggagctcttaacttcccaatttgtaaactgagattagtcccccgccctttcctacaagtccctttcctgtccctaccacacagcaacttctgcatctttgtttttacttttacatcattgaggttgatggcatttacactctgtcctgtaatcataactaaaccttccttacttttccattggttgattctaaaagattaaaatcaataaatagcatttactttctcataactaagtgattatctttcatgatagagctaaggagtgccctgtgattgcaattctttttgtttcactttttgttttcctggagttttaaattgtttttgttttttacctgaaatatttaattttattacatcctctctctccttttttcaaatcctctcagctattctgttgcattgcccttttccccaagtctgtctctctgagtgccctccatagccctggtattgtctggactactttttccaacctctacactaaggccatcctgggacctccccacagtgctccctcatgttggggcaactgtttcctagatctcatagatcacgtgatttactccctcttttgtctggagtgcattctcttaatgatttactaagaaaggagtgcaggaagtaaattttctgaattcttgaatagctaaaaatgtctcttttttcacacatttgaaattttagctgtatgtagaattgtagtgtttttattaactctttattcgtcaaagctagagggtatagctccattgtttccagcattttgagatgctaaagataaacctcatgttggtctgtgatatggtttggctatgtccccacccaaatctcatcttgaattgtagtttccataatccccaagtgtcgtgggagggactttgtgggaggtaattgaatcatgggggcagttactcccatgctgttctcttgatagtgaatgagtgctcatttgatctgatggttttataaggggctttttcccctttgctgggcacttctccttgccaccatatgaagaaggatgggtttgctttcccttccaccatgattgtaagtttcctgaggcctctgcagccctgcagaactgtgagtcaattaaatttctttcctttataaattacccagtctcaggcagttctttacagcagtgtgagaatagacttctgataattgttcctctgcaaatcaccttttttctttccaaaagctttttgaattttgaaataatatatctatgtgtgtgttttcttttcacttatcaccgtttcatccatatactttcaatcgttcctcctgtttgaactgcatttctgagtctcatacgatgctttacctggagctctgagtccccatgattctctctgaggtttcagctctgcaagtgtccaggttgctgtgccctccagcctgactcatccctcatgacccttctatctactttctgtcttccagaaacatgaaatctctcagccctcccctgttgtctttattattgtacatatattttatttctttattatcattgcaattaggtttctggagggaaaacaaactaatgtgataaatctactaacttaagttggagacttccagtgttttcttaataaccatcttcttgtttaaaaagtaacctatgcagtatggaaaataataatcccttgtcattgcacatcacactacccgtaggtaactactgtgagaaatttgataaattatcctttgagatttcttttctggaaatgtatatttgttcttcatttatttgggtttttttaaaaaaatgattaagccattttcccaacaccatcgattgtggaagtcttcctttccctactgatttggaatgacatctttattaaatgtaaaattatcatacaaaccagtgtgcattaaaggtgcctgtccactactgatggttgcctcagtcagatgtcaggtggttccagaaatacgcttattattagcaactttaaaaaataaatcccctgtccctatgcttcctttttaaaaccacctatctatttcttcttatatgcgaacttcagaattattttatttgactctctactgaaaagaaattcattggtttgctattaaaattaaattcatttctttaaccaatattaagtatttaccatgtgtgaagccctatgtaaggtgctaaaaaatgtacaaatgaataaggtgggtatggtctctgccattatgaaggttaaatataataaattcagttctttccaaactgatcaccattttgaaaactttaccatgtcttttctcttattccagaaacataggtgtttctattccttttttctaaataatatccttccatttcatcatgtgtaatgctgctatgttttgtttttagccttctttttgcaatttactaaatgcttatgatcctacaaactatttgcccagtatttctttatattatttttatcacttaatttgaatttatcatcaaattgatagtagtttagaactagctatggatgaactgattttagagattacttttttttacatgttgagtttttaattttgagccattaattttgagttgccttcataagtcagtgtagaatatattcaagtaaaagataaggccgggcacagtggctcacccctgtaatcccagcactttgggaggctgaggctggcggatcagttgaagtcaggagtttgaggccaacttggccaacaaggcgaaaccccctctctactaaaaatacaaaaataagccgggcgtggtggcgcacacctgtaatctcagctattcgggagactgaggcaggacaatcgcttgaacccaggaagtggaggttgcagtgagctgagatcgtgccactgcactctagcctgggtgacagagtgagactctgcctcaaaaaaaaaaaaaaagtagaagatacactttaatacaaaaatatattggttgttaaaaaaacacattgaaatattaaacattaagtattagcaatagacagaaaggaggagaagcttcagatcagcctaaattttgatcctttgtcaaaacttatttccttattactagattattgtggaatttcggttttcccataactcaaaggttctagcacaacatatttagatgtttcattattttccctggaatgtgggaaatcccttttagtcttcacattcgggtcttttttcctacacagaagtttcgtcctctttgtctttggttatcgtgtctgtagccactctggtttctctgtagaagcactgctcttcccagccggtaggaaggctcatcttcttctttacacctccatgtcaccttcctctgccttgtgggagaacctcccacattttcctcaattttcctgacccaaatttttctaattttagttttagtttccttgcagccccctcatctccctttttgatcttatcttggacttttagaattctgttctctttatttttagtgtgacttccctttcctttattctgcaccatttgaccctcacagttccgcacctcaggaaggagaatgcctcccacacctgatacctggccacagacaaagggtgagagtcacctttgactctgtgttctgactttttaggtgctactgagctcttctccggtgtaaatctggaagacagtctaacccatgtgcatctggcatggatcgtctgggctgagttgacatttttttttctaccttcttaagaatttttctttgacattctatgtaaattagtacacatggaaaattacaatcttccttaacacccatttagcaaaggtttgactttccaaatctgtggctggtgtgagcccagcatttctgagggaagaatagtacagtggggaagagaaaaaccttttccttctgcgttctcatggctggggctgccctgttccctacagggaagaaactgggcaagaccttgtctggtttcaccagtgccatctgtgttgcagttagagattttcaacattcatttctaatggcattgtgacttttcatcatttctgtgtgtctctttagacatgataacacaaagttagtaaaggtctccctctgccggccaggcaccactgcttgctggagacctctgtctggagagtccacactcgatgtggtgtatggtgtgctgtttgtgagcaagtaaatgttttattttcccttccagcagcaaaagtgtgactacaaaccttatagagcaaaagaatgtccctttgtccaaagcgtcgctgcctcgcaaggtgcctaccttgtccccagaaagctgctagaacgccttcaagattgccctgttggtggtgatgcttcaccctcgtacaccgacttgatttttagaaaataactaaaatgtatttggggccaggcacagtggttcatgcttgtcatcccagcactttgggaggccaaggcaggtggatcacttgaggccaggagttcaagaccagcctgggtaacatggtgaaaccccgtctctactaaaaatacaaaaattagccgggcatggtagcaggcacctgtaatcccagctatttggtaggcggaggcatgagaatcacttgaacccaggaggcggaggttgcagtgagctgagatcacaccactgcactccagcctgggcaacagagcgagactccgtctaaaaaacataaaaaatcaagtgtatttggcaccaggtatagtcactgatgcaactcatggacttaggaaatgttgactagagatgagatgttgctatgcgggtcatgaggcaacatcaagctctcagggcaagtcggcacaaggggcccaaaagctttatgataaatggcaacaggattagaagaggcaaagaactgcccaaaatgtgagaatcacggcttccttacatagaggtggagcccttatggatgcatgtatgtaaaaagaaatcttattatataatctttataaattccattaatagtgtttattgttttgggtttttaaaaatatttcacactgtatttcatcaccataacatctctaagggtgccaccaggctttaaaaattcatattacacaaatgaagaaactgagggttgaagcaccgtatagaattaattgtagaaccaaggctttctcaggcctctgaggtgagccacattctgcccctcaacccagggatgagccacgaggcagagtgggtccacatttaactgtcctaatttttagtacaattatatttttcctcagtgcaacagcctcatattacaaactaagagaagggaggaaaggagggagggagggagggagaggaaaggaaggagggagggaggggaggggagggagggagggaaaaaagagatgatctagcactcactttatgtaactggtcattttacttggggctctgtattagtcagttctcacactgctaataaacacatacttgaggctgggcacggtggtccatgcctgtagtcccagcactttgggaggccgaggctggcagattacttgaggtcaggaacttgagaccagcctggccaacatggtgaaaccccatctctactaaaaacacaaaaattagccaggcatggtggcagacatctgtaatcccaactacttgggaggctgaggcatgagaatcgcttgaacctgggaggtacaggttgcagtgagccaagatattgtgccactgcactccagcctggggaatagagtgagactctgtctcaaaaaaataaaaataaaaataaataaataaaataaagacctacctgagactgggtaatttagaaagagagaggtttcatagactcagttctacatggctggggaggcctcacaatcatggtggaagacgaaagaagggcaaaggggtgtcttacctggtggcaggcaagagagcgtgtgcagggagactgccatttataaaaccatcagatctcgtgagaacttattccctaccatgggaacagcatgggggaaaccacccgcatgattcaattgtctacacctggccccgcccttgacatgtggggattattacaattcaaggtgagatttgccggggggacatggccaaaccatatcaggctctgagtaaagaaacagtgtggtggctacttctagaaaataacaaaccacaccagagtaacacatccttgcctccttctaaagccatgaagcaggcttgtccctgtgtgtccacgttttgtggccaagagctttaagcaggaacagtactgtgactccgcgggccatgtcactgctgttgatgctgcacaccccagccccctggttccatccagtggcactcagcctagtgacatttccagcacgatttgttctggaggcatcaagagaaagtttgcatccatctcattttcatttataacatttcacttccaaattaagaaatagaaaaactaagaatagtgtgtagtcatatttggcctagatgaagattatttgtacaaaagaacactataaaaagcagaaagaagcataggatgaatgaatgtttccaacaattgagaacaaaagcagcattcttcctaattagcatgaaggacatagagggaaaaaatagtcattccgggagaccttacattttctttcttgattgcatgcagacgaaatgtgtttgctgagagagtaagtgcagggtaccctgtggcttcgccactgcccccattgtggacatggaatcttgcaaccacaggccccatgtggctctcacacacgtcccatggtagggaataagttctcatgagatctgatggttttataaatggcagtttccctgcacacgcttcagcgtcctccagtgtggactcaaagaccagttacaacatcattaaaaaataaaagtgttctatgtaaagcaagggctaggcagagacgttgaattatatttaaggacaaaagtgacatatatttttttcttatgattgtaaataatgaccaaatcccatcattataaatgcctgtccctgcctttgggccatgaaacagcaaagcaggacctttgtagaatgttgctggcaggatgtgccacctgtcagtgccagggccaggatggagagcaggggggagggcatggtccctgtggacatgcaagccaggttctggggcaggccaggctctaggacgggccagtatggggagcagatggtgggaagaaaagcaaccatgtttcagacatcacagaaatggagcaggttgaaaggcacgagagctggattacagctgagcgcccctcctgtgttcacgggttatgtacctcctcaccaccccagtcctcaggaactccccatgaccacagtgggcagctgcagacctcccctcctggccatgcgccagcagccgcctgtcttaggccctcacctgcttgccgctgttccttctgtttgccacatggtcctgatttaggtcaagttattaagaaccttgattaacaagttttaattgtgggaaatgggggagatgtggcactggaatctcctggttaactgaggctccagccaaggcatctggctatagtcgtttctgttaaaataattattaagtgtagtgaggtcgctctctggctcgccaggaattgtctagtgaatgtactgctgtctttagtgataaaagatcttgtaagaccacaaagtaatcattctgaacagtagatctcattatagatagagaaggggtgaatgattgaacgcgcattagctggcttctagaacattctgggattcacctggggatggtctttttggggcattaattttctcaacactttcttcttcctcttaaatgtaaaattgtatttttttaatctggtttttggagggctctgggtgactggatgaattcccagaagccccggtacccctcgggctaagtagagagccgcacagagcctgtggtagtttcaggtttgggcagaatcaggcgcatgacccttaagatatcaaaccaagttcgcctgaagcccagagccatgaaccaatttccctaattagctagagagtgtccctgggtattttatctttaaggaggaggaattagagaatggagccttcaacagcccaggctgggatgcttctcaccctgtgtcgctctctggggcctcccgccagcccttttccggttctttctctgtcccgcctccccggacccctcgctgcccggtcaggtggttagttgtgcgtttgcctggtactgcggtgtgaaagtcaaggcatcagctggagagacgagacctcaaaacccacggagcagcccccacacccctcacccccagggcagccacacgcagtgacatgcaactcccagtgtctttgggtttatttagcaagaggtaatgactgggcggcccctcagagtcccgcgccagtgcagattctttataagccagatttcagaagctcgcaggctggctgtgtcaccactggctccggcccccggctcccgtgtcgtgtccagggctggggtcggcggtcccctggcttctgtcgtgcgggggtcctgccaagctgctcatgctgtgtttggcgtttccagggagtactacatcaccatggtgaagtgggccaccagcaccaaggtcgccgtgacctggctgaaccgggcgcagaacgtgtccatcctcaccctctgcgacgccaccacgggggtctgcacgaaggtacgcggggctgtgggggtggaggggagacgggtgaagaaccgatggtcagacgcgcccgaggtggcgccagagtcgtctcagccctcgggcctgggacttggggaccggccgcccagctgctgcggggagcccgcggcgcagagtcccggctccggcgtggctgccacctcgtggctggtgcaggcgctgccgcagacccgaccgaacccatccgtgaattgccagaggcgccccgtgcctggcacctggacgccgtccgcagttcactgagtgttgcttccctttatccgcgctcaccgctgtgacctaagtgagcgtcctcctcgttgcagctgatgctcagagaggaggggccctgcctttccccagaccccgccgacagcctcccccagcgggctccaggcgtgcgtccctccccacgtcctggtgaggccagccatgtttctaggagtctcaggccgactcagtgtgtagtgagagaaggtaaacgtaggggaaagaaaattaaaatgctcaaagagtgagcaaaggaaaaatgaagtgtaagagaggttgcccgggtggagcaggcaggcggcccacggcctcaccctcgccccatgggatgggcccccagaagcaggtcaccttgtggcgggttttgtagacatcaaataatatcgattaatacattcaggcaggcctttcagaaactcctttttgatcttaagtttctgtctcctggctgaggggggccaaggcttgcaggcatatttacttgagaggctcctaacacgacagctgtgcctgagatcctaagcacagtgattgtttctaaggtggtcagtcttgcctgaccttttatctaacctggggcggattccaggctattctgatgagcttgcttgaggggaaggaaggaacgtgaggacacaaagcaggcagctaaaaatggcttgtaatctccaacttctccatgcccctgagccttgagtgtcagtggcaaacactgcttcctgctataacccatgacagaggcctgctccaggggcccggaggtccagtctgcaccagcaccaggcccacagcgcctccaggtgacacatgtgtgctgcacagcttgagtttggtgtctggagttttgtttttcttttgtttgcacctttccatagaccactgtgagacccacttttcctctatgctttagcccctttgaaagggtttctggtccaccaggagtgttactcagtattccagaatgggatctggacacaatgtccaatgttctgactcagtgtaggctgaggttcactattagatggacacatgcccgggcagtgatgaccgccccctggtacacgtgccatcttcccccagagggttcttttccaccacgggtttgtccttgttgctagggatagtggcattttctaattcgaggacgcttgtgtttggctccgagccacgcacgagacaaagaggagagctcgggattgcctcctcccagagctgccgtggcagctgtgcaatgcttgtgcagcggccatgtaggtgaagccaaattgtttcctgcactgtcggtcacagacacaatacatgcaaaaaaaaaaaagaaaagaaaagaaaaaccctcttgtctaatgctctcatttcatttcagaaacacgaggatgaaagtgaggcctggctccacagacaggtaactactgcatgtccgggtccccactgtcacctccacctgatccaccccagggctggccctcagagcttcgacaacagcagaatggcttctcagagtaaatcacacagggctccccaggcagaaacagacggcgtgccggctccactcacggtgcctcccgttctccagggttgcccagagagctccaggagaatccaagttccagggagggtcgtgtgaaaatcacggctcttcagagcgtggaatgtttggtgagacctcagcttgcagttagatgccagcaccttgctgaattgaaaatgaacagtccatcaaaggtggcttaacataatctactatagtaaaagggtggaaaagtggtggatatccctgtttgttgccaggggtggttttgttggtgtctcatttggagtcacctcctctgtgattccgtaagacccgtcctcagggacataactgcaaaccatccctggagagtcttcatccctaactcagataaaggaacacacattaaaacagactctaggaacttgagaccaaaagagatcaggagaagcccaggtaaatcattctgagacaattttttctaaattaaacttgcacaaaaagtatcagtattttctttcttcaagcctttttgtctcattccacactctgacactaagaagaacaggtgaaaaagctttggaagcttcctgtctccttatccttcctaaggggatgaaaattgtcttaaagactctggaaaaagtcaagccagacttcagtctcatgaattatggtagagacacaggtatgcttcttcatcgatatggtggatcctatttatggaaaataactgaagctggacaaaactatcgccatggctctccaagaacattccagcactatagatgctgggctgctgcttctgcctgtggagtcaggaatataattatctcagaagtcagagcctcatcaacagacgggctgctccgaaatgtatcctgtttctgctctgtgtcaatcttattcacaagaggaatggttccacatggccactttcattttacatgtcccaatttgggtgccaagtccaagccaagaagatatcgggaagagggaagacttagggaaccctcaaacattagcatgctggaaagttcttgaatgccacctggaccaaacatataagcatataagcatacatatcaaaaatagtattgtgatgttcatctcacattagacaaattgtcagagagattacaataaaaggaacattttgtaaactccgttatctatatatcatgtgttcaaccaatatttatggatcttaccaggcaccatgctaggctgtggatttcaaaaaatgagtcggctactatcactgagcacacattgtggtgtgtgtcagaattttattccttcttatggctgaataatattccagaatatgtatgtagtatatatcctggaatattatacatatgtatgtgtgtgtgttatatgtatatatacatatatatacaatataatacatatactggaatattattcagccgtaagaagaactgaaatagtattccagtatattccagtttgtttgtctgttgatggacatttgggttctgtctaccttttggctgttgtgaaaagcacatctaataacagatacaaaaggctaccttattgtacaattccatctatataaaatatccagaataaataaactcatagacacagaaagctgatcagtggtgtcccaaggccgggggagtatggagaggaacagcttaatgaacaggggtttattttggggtggtggaaatgttttggaactagatagaggtggctgcacgtcattgtgaatggactaaatgccactcaattgttcacttttattagtacgttttcttttgtgttatgggaattttacctcaacgattttttaaaaaattaataagctagagcatgagctcttaaagatggtacatcctagacagggagatgagatgttcacgttacatccattgtgcaggctacgagggtgatcctcagacattcagaagcattgctgaagtattcgggtgttggtgggagtgggagccagaaaaagcgtggtggacatggagcaggaggccctatgccaggcccactttgtgtttgaacaggaggaggtgagggacgtgattctttgttgggggcagggaggctatgggaaagcaaggtggacatgcacactctgcttccctgtccccctcaagaggcattctcacagggggagctggcttcccagctggccacctgcagttctgccctctggatggacggcagagtgcatggtccctggaggcccatggggggccgtggttctgtcctccagcgctcacttcattagctctacagagtagctacagagccgaggtcgtcagcaggactttcctgtattagcgattgtgtgtctcatcgcccatatgagaacagctactaaagtgtggggtaagacagcctgaatgggattccagaaaccagatccttccaagcagaatccagtcaacacttaaaaggtggcatgaattaaaataattcttactgttttcaaatgtaaagtttaaagcatttactaagcacacagctaaatttttaaaatagctgcttaaacgtatgcaatgctgccatgagttggaaacataaggttctgtgacaggtgtgttttcctgggatggagcgtccctgggtcaggtcagcccatcagctgcagttgtgattgtgacactgggttggggcatcccgcccatggcagcagttgggaggccaggatgtctctgaagaccctacaggttgtgagtctgcacctgtgaagattgcagctccatggtctgcaggaagatttaatttcaaacagtttcttatgacattgtttttttcgtaaaggaattcatggaccctatttttcaaaaacaatctgtagtgtttctgcatccctcgagttactgtgatatcctggagaacaacttagtaactttttaagactgaacctgccacctgctgccagcgaagccattggctgctgcttcagacagagcctaagggggttttcctgggagggctgcaggcatgagtgagggagacacatggaggccacatgccctctacccatccatctccaatgggtcacagaagcttgccccagctggcccaggagaaactggcatctggaaggtcctgcagacctcagggagacccggcctgcttaggtccaccgatcttccaaggacccggtgcaagaacagaggtgagttgtagcgagcctgctaattttgtgtcatctgagctgttcatctgagccgttcatcctcctctcttctcttcccaactccttcctggaatcctcagtacggtcacccgcagagattccccatgagccaaacagaagaggaaaatgcatgtgtggagacccaccaagttccctctcctctaggaatattccagagaagcaggcaatcccccctgccacatacacaccctgtcactgctgcgctgaccctgcagagtcagtcctgatgcagacccatgaggatcctctgccagaaccatctgcatttgccatagaaccccagagcctattgttttggttgaaggatcggttccatggatccatttctgactgtctttattcttttatcggaattttggttttgtgatttcaaaatttgggctggaaggggggttggacaaaattattatatctgaaccatgggaaaaaaacactggcaaaaatgctacaaataactcacaaagaagctctcatgagtcaaaagggctccttcttcacagatctgctgagtggagttgaggaaaccaggcattgtgtgtgataaattctgttatccagagagactagaaacgcttcccccaaaatcaaatgagagacagaaccaggataaaatccaggtcccctggtcaacaatcattgcactttgtcactaaaaatacatttaccacatgagaaaccgggtctcagagagactcagaggcttcacctgtgttccgaggaatgtttccctgacaaggtagagatgacatcacaacggtggaggccttcttattataaaaacaatgcttctggccagaattaattatttattacatttatttagagtatctttgtctgccaaacgtgcaaacatttcccccagaaaactgaaggaatatagcgctacccgccgcacagttggcaaatagaagtgcattttaaaagccaaattaaccgctggtttttccatttcctctgcttttaaataccatgcttccaactctaaataggaaaataaatgtttgcagattaaaggttccattttattgcaaatattcatgaagattaaatgtcattttaatcacatgttagtttatttctctgggcatatcatatctgcatgggttcactcactgtagggaaatgagttttgcttgtgccagctggggtttatttaccattagttctcatccccgcattcgtgtgaagctccttgagtcagaaaatacatctcgcaaccaactaattggtgttcacggatggaaactttcaaacttgggcttcagagaggccaaggtaccgcggtagcaaaatcctttttcgcccatcaaagcaacagccaccctgtgggctggtggaaggctgaggccgctggctgttcactgtccggggaccaggcagagatggtggcgacacctgccctaaatccagcctggaacccttcccccagggaaaactgggcatgctgattctgtttccagggaaaagagacagtagatccaagcaagtgttgtcatccagtgtggcccgaggtggagcgtgtccctgggactgctgtcccctcccacctgtgttttagaacccgtggcatttgtccttgtgtttattttctttttttcttgccttcttgatgggctattcagtgtgagatcaattgtattcaataagaagaaaagacaggattgaaagaatagattttgcttttaggcaaaatctggtttgggattgttgagaattatgtttttttctgatatataataaatgccactggagaaatctcacaatacactctggtttcaatgggcaataattcaaggaggaagcacctccttttgagttttgagagcagagttcctgttctcactggtgagcttggcgtgcacatggggctgggctttgtctcggtgctgtgtagactgagggatgcctttttatttgccactgccggggctgtagcctcttaattcctccatcttcttcttttagaaaacgtaacagttgactcatgattcccgaggaaagtgacggcctcatcaagcacttattatttcaactgttcctctccttagaaatcacatagaaaatgtatctcggggtgtattttatcctggttcaacctcttcagaataaatgatgttttagttgtggtttcatccgtggcctttgtccacagaatgaagaacctgtgttctccaaggatggccgaaagtttttcttcatcagagccatcccccagggaggacgagggaaattctatcacatcacggtgtcctcgtcccaggtaagtcctgctagtttccggagctgaactagaaactggcctgctagaggccgtggggtgacagcctctagggctgggcacacttgcgttttcgaggaccccaaggaatctgaaggtggttcccgaaggcagggcagggcatggcgctggtgagtgcagaggttcccatcaggcctggtggaaccttgctctatctggtcacgtgcgagaatgtgaatgacgcttctgccaaggtcagcagagaccctggggtcccctgttcagtgtaaggccaaggatgttggaggactgtctgtgccgggggccctttccttctccctctgctgagggtctccttaacatactccccgctgaggcatggctccatgcactcaacatccctcaggggtccagcctcccatgctgccctacctccacccggagttggatgcaggtattattttattatgtgaccgctaccagccatcactcactggttctggggtctggcgagttcggaatggagcatccctgagtagggaatctcagagattaatatacgtgaatctaggatcaaaagtagacatctcggggtcaccatctcctgaagaggtcacctcagggagcctcacgcctgcaggacggggctgccatggtgttgactttgggggactctgccctgaggaagaagggaagcatgatcttggatctcctcagttttggaggcagtctaaagttatttgggatcagggtaaatgaatgaaatttgattagagaaaatgttaatcacaaatattctatggctatgacatagaaggctcatatttatgatgaggcctcaaaggcaatttcaaaagaaaatccaagaacatccgcactaagagcagctctgatggaatcagggtgggggctgcgggacccctgggatggaatcggggtgggggctgcgggactcctgggatggaaatggcgtctcttggaggttcaggtgcaattttttctcagtgcacttcatgacacgattgatagaatgtctgcaagctgttgcctttgctttttcctgcggtcttcattctaccatccaaattcttttgtttattattttacatcacttatatcaagattttaaaatgctggccaggtgcggtggctcacgcctgtaatcccagcactttgggaggccaaggcaggtggattacctgagatcaggagttcaagaccagtggccaacatggcgaaacaaaaattagctgggcatggtggcacctgcctgtagtcccagctacttgggagactgaagtaggagaattgcttgaacccgggaggcggaggctgcagtaagctgagatcgtgccactgcactccagcctgggtgacagagtgagacactgtctcaaaaaaaaaaaaaaaaaagatttataaatgcttcagtgttttcatttggctcccagtcttgtatttatccaagttgccatcatttgcccggagccctatcaaacattccagcaggaagcaggtctcctgcactgcccatgaggcaccacctcctgcaggttcccaggaacccctcggggggcccccagggccttccctttcaaaacctgcttcaaactccccagcctctcctacacgctgtctgcgcccccaggccctgctgccccccaacccccatgttcgagtctgcagcccacagagtgtgtgccttgggccctccacctagtttaatctccacctgctctgcgcccacctcccagggcatctgccttccagaacagctgcccatttcaaatccccactgaaacatcgctcccgcctagatggccctgtctctctcttctgttaccattggtcgttaccattgtctgttaccattcttcttagctcaaggggaacatagggaaagacaatgcgtgcaaaacttgtagtgtggcaatacaggtccaaactgtccttgtcagtggcagcagggagcgccctttctccctccgtttattcttctctctttttccctccacctcccggcatttgtctctttcctccctcactggtcccccttcagtaatggctccattaattagatttacaaatgaaaaaggcctataaagcattgattctcctcctgagatgcttccatcatggttggaggccaggtccaagtgattcgcgtcaccaaagaggacagggcactgttcccaccactgacattcgggggtcggggaggctgcgggcctggggttggttgggaagcctcaaggaggatgttgcctcccaggagaggagcaggcagaaggggcagagagcccttcccacagagagaatggcagcccctgtcacctggtgtccaaaacagttggaggatgaagagccatgctggggccgggacaccggtgtctgctcctgatgccatgtctgtgtgtttcagcccaacagcagcaacgacaacatccagtccatcacctccggggactgggacgtgaccaagatcctagcctacgatgagaaggggaataagatgtgagtgagaaccaggggcctgccccatcttactggccaatggggcacatttgttattttttgtcaattacacttatggagtacaggagcacaggaggcctcctctttcctcctcaggcagcatcactgactcctagtttcttcatgaaaatgtatagtagattcccgtcccaacagtccgacttccagagctgcggcgtcctgaggacgcaattaggcttgcagccagcccatgaagggaagcacgctagcggcagtagtaggggtagtactgatgttgattgagtttttactagtccaggctctaagccaagtgctttacagacattatctcattgaatacaacagttccatgaggtgagtttactgctttccccattttaaaaataagtaaatgaaaacaaaaataagtaatttgctccaggttattcagttggtagcgggtagatttggctcagatgaggggagcccagttcggaggactttaccaccatacaatttcacctccctgctcctggggtaaaagccaaggtttctgcattgggaggtcttaggtgaaaatgagtcaacaactatttattgggccaggctatatgtctgaacttgtcttaaatgtgctcagctccttgcccttcagaaggtgagtgatcttgtaaaagatttccacatccacattcaggtgtgtgtcacccccaaccacagtaccctctggccacgaagcagaggccagtgcagggggcacccggagccagtggaatctgcactggtgtccctcagcccttaggtgtctggccaccccctgctctggtcacaggtgtagctggacctgaacaggggagctactccctgcaggccatgggcggcagtccctgaggagtgtccatagaggtagtgccaggaatgtgaagtgcagacgtgccttggagcaaactaaccctgtgcaccttggtgatctttgcagctacttcctgagcacggaggacctgcctcggagacgacaactctacaggtaactcctgctccccctgcacacagggctctcccccttaggagggcatccaggctttgcagaattgcaccttttcagcagttcggaaagggcggcagcaaagacagaccccaccacagaggagtagctgtagagtctggagagaagtaatgaaacttgcagaggccaccaaaggggtagttttgagacttttgaagctttatttttctgctgttgttgacttgggttttccctgtcacccacttgcctctttggctaacggatggactttaacccgtctttccttttcacttctattcaatgtcacctcggaggaattctgccccccctgccccaccacagattttttgtagggagcagagtgtgatttggaaacaaacccgtgggtcagcacgaggaggccggccctgctgtccggcattgtagctcactggctttggggaactctgccctgaggaagacagggagcatgatctcgaagctcctcagtttggaagcagtctaaagttatttgggatcagggtaggtaaatgaaatttgattagaaaaaaaaggttaatcacaaatattctatagctataaagtagaaggctaatatttatgatgaggccctaaaggcaatttcccttctcaacagcccaactgtgcgactttggacaagtttccaaatctcaaagagggcagggaccctgtgttctgaaccctggagggggactggttttttttctagggcgtgtccctcttctacatttagtcctgtcatctgcccagtcactgttctcactaaaggaggctttgggttgtgaagtgagattagccctgggcactttctaccagggccacagaggtgaggagggggtgtctgctgcctcccccgtgcctctgcatgggatggctgcagccagttacacctaaaggcacctgggccgctgaagaggatgttgttcaggggagacctgaggcttgaggccagtggcgcattgtctaaatggtgccaatgcctgttgcccccgccccactgctgggacattgggaagcccccctggtgaacgcagcctcccttcccagccatcggccgctatgcggacaggatgaggtcagcatgagggagccagtccgtgtagatgttccatcgtcaccatgtgtctactaggaaaattgaaatacacatgtcaccaattaataaacatgagaggctgcctgtggcccctgtcctctaaattacagaatgagaaggttgtcttctctctcccgtgaaatatctttgctcctggaacaacagacttcatattgaaacctatggttagaggggaccctcctgcggcaaaatgttcagataagaacttcttccaggtagatccggtatcttaggatctttccattttagggagcacattttaggccttcttgacttgaaatgacacttgaccacagtggtcccaggtaacatcttcaagccagttcccacttgtgtagctccgttgagtgggaagcgcgagctctcgaggtttcactctgtcaggggatgtggcttttggaagctgccagagttcaattccactggtgctgctggagcccctgcctgctcacatgccagcgtttggaacccagataatttgaagatatgtcactctgtctactgttctcagattgctagccatccactcagagggacaggacacgtgcagatagagtgctagatcatataacactgacagctccatgctcctcacaccaggccacctgcagagcctggagaaggcagcataggtgactgccttccagccctcccacaagcaaggatgctgaaagctcttgagagtgggagggacccaccagcaaaggaaggtggaaatggagctgggtggtctcaggggctccagcagggagacagagggagaggcccggggggtctgtagcagggctccgcagatcaccctcatggggagagcccaccagcttgcggcacccagcgtggagggcagctcctctccgcccacattcacacctgcgtcctttgctcttccagtgccaacacggtgggcaacttcaacaggcagtgcctctcctgtgacctggttgagaactgcacctacttcagcgcttccttcagccatagcatggacttcttcctgctcaagtgcgaaggtcagctcctgccaccccgtcagggcaaagagccctggcaggcacatttgcagggagggggtgggcacacttgcagggagggggcagcggctgtggtgggagcacagcgtattccagaacaggtgaggatcccgcctacctgataacattgcttatggtgcaagatgactggacccccacagagcctggtgcagtggggctactttacgtttcatacaggtgtacagcttatcagagtgttctgtgcacactgtgccagtaatctctcagtttgtctcccattgtccacaaaaaataatagtcccatgagctaggaagggcaaatatcctacacagtgatgagccaaagccatcaatccatcaataaagataggaaaacaatttcaaagattaacttttcaatcatatttaaggatgattgaatatcaccaggcacggtggctcacgcttgtaatcccagcgctttgggaggccaaggtgggcagattcacctgaggtcaggagttcgagacctgcctggctaacatggcgaaatcccgtctctactaaaaatacaaaaattagccgggcctggtggtgaatgcctgtaatctcagctactagggaggctgaggcagaagaattgcttgaacccaggaggtggaggttgcagtgagctgagatcgcaccactacactccagcctgggcaacagagtgagactccatctcaaatgactagataagaaaaaaaggattgaggttatgttaaagaagtctcagaaaaatatttccctatgtcccaattcattgataatttatcccaaactgcaagagtttgatcacaccaaccagcatacacaaaagagtaggccatgttgcatatgggatacaaaggatatttttgctgcttgtctgtatcttggaaagatatgatatgaacccatggaaaggtaagtcatcctaaatatggtcgtaacaaaatatgatctcctgcgatgacctcaaagaatgaaaatatgccacaggcagagactaagatcaggagcaatttgctcctctgtcagagtttcaatcccctaagccataggtggagaatgaataacttttatcagagcaatgtctttgctagcctttgctagctactagagagctcatgacttcatgacttcgttctctttttatcagtgtcatctaaaatcttgaaaatccgcagaacagggacactcagcctcttgctcaacacaagctcagcccctgacattcttctaagacagcaaggagaccacggagggatgaggggggtgcgactgaaatataacattagtgccccagtccccgcaacgttaatggtaccaaattcctctttcctgtgtgtcccaagaaggaggccaccaagtatctgaaatcatagagtgctgtaggggaaagaacctaagatctaactgacccacttcatgtatcagatggcaaaccctaagccagaagttgagtggattccctgactcccaatgagccagtgacacagagagggccagcatcaaggtctcccagttcctagcccagtgacatctgtctcctagggcgggatcttcttgaaataagaacttgggaaattacagggattgacggggcatagggattgggaaaatgtggcaagcagacccactaggagccagagagtcttttgaggagctacataatcagaatccacaatcctgtctcagaagcaggaggcagcttcagcacacaggaggtcatgatcaaacacagaagtgaaaaattgaagtagatttcaagaagagtgccccaagcaacaaaggttgaatgagaaaggtgacagagcctccatcgtggagatcctgagtcagggacagaggtcatttgccagaggggcttggtctggcctaggcaggaggcagagcctttgggatctgaggtctgcactggtcaagacagcaactttatggatttgtatttcccaaattcttactataaccagcaagaagggtctggcttctcaccgttcatggaaagaagtcaaaataataatgagttgtgatatgaaggagtgatatttctttattacctatgccaccaaggggaagagcagaaagcaattccactcttcaatttgtggagcaaatacagggtttctttttttaaaaaaaaaaaagaagaagaagggtttggaatggggaagagcttggggggttaggaggtgccaaggagtgtgactggctgtggtggcccctctttaattattgtcccatttgatgaaggagctggcaccattgtggatcccaccaggttatcagttaatcacagtcagccttgtagtcactcttcagccatgagcgggtttcatccttgaagtaatcttttgttaaagaaagaattctggaggtatctgggtcctatcaggagctgactcctggaggttttaaggaaatacatgaccagataagaaagcatggtgtgtgctccacaagcatccgggttaataaatgtgcataaggcatgagagcatagaatgggaaaagaaagggagtggaggcgacagcacattctgaggctgtgtttcaagatgaaaggtaacacatacgcagcttgtctcaaagttgtatcttgagacagggagcagacagaagaggagaggagaaagaaaaaaagtttaaatcgtggtttgaggctgagctgctcggtcatattcctaacacatactaacatctgctccacatggtgaccctcccagaatccagaatccaacagcttatttgttgttgttgttgttgtttgagatggagtcttgctctgccgcccaggctggagtgcactagtgccatctcagctcactgcaacctctgcctcccggtttcaagcgattctcctgcctcagcctcccaagtagctgggattacatggatacataatttttgtatttttagtaaagacagggttttgccatgttggccaggctggtctcacactcctggtctcaaatgttccacctgccttggcctcccaaagtgctgggattacagacaaaagccacctcacctggcccttacttaacaaacactttcgctgcttccctttggaggtcacagctccctgctaagttcaagctcaagttcagtctggatgcctcattctgacaactggaagccttttatggttcagtttccataagctgcagccctgggttgaaatccaaaaggctctcccaggagatccatggccatggatttaggcagggaagttccagttcccacatggtggatgtaaacatggagcccgtggtagatagaaacacagcctggtgttgggaggctgcttggacagagtgttaaagtttagagagcactatagggtggctcctgtgcggatttctagtctgccactggccttctgtcccaagggagattcgtatttctttttatgtttatgtatttgcaaggcttgtgttgtggtctgcaaatagttattgtgaagagatgactccatagttgatacctgggaggaaaacagaagcaaagaacaagtacagcaacacaaggtcagacacacgactgacccagcccccaggtacagccacactgggtcacacacacatgactgacccggaccccaggtacagccacactgggtcacacacacgactgacccagtccccaagtacagccacactgggtcacacacacacaactaacctggcccattgggcacctccacaatctcaccttcagaaaggatgggatgctcctcctgccaatgcctggatccctataataatcaaacagattcctagaatttgaagataggaatagatctcagagcatctaatccagtctccaccctgcctttcttttgttgattcagaaactgaactcttagtcattatgaaattatcacgctagggtttcctgaatcatttaagatctatttaaatatttagcctgttgcctcatcttaaggtagacataaactagccctcttctctacaaaattgctctttaaagtgtttacataataagctattttctggctaaagtaacttttgaatgcccaaattaaactctccccatggaggtaaccaaaatcccacttataaaaagagattttctgaaaaggtttaaatttacaaagacaacaaagtacatggggagacaggagcagccaactgtttgaacctggaagcagttaccagtgataactgacctggcagaccctgaagctgagcctcgtcctgccatggggaaagctgagcaggcattggcgatgattgcctaagggatgagaagatcaattgctatgaaatcttaaaggagaaagtgattatacccatttggattgcttggggcattttgctggaggagaagactcaaggaaggtgtcaatgatgaggtggcatttaaaacaaatgagtaggtaggatttggaatgggaaaaagcagtccaagtggaaggtacaccctgagaaaaagcacaagaaatgttgtaagattatgcaatggaatcttttgcagcatgtgaatcaggatcaagtgaatacaagcaacctgatttaataaacaaagataatttaaaataattttatttttctccacgtttctcagtagatattaaaatggacccagatgtgtagtctagagcaacgtttagtcaatgctcatgtcctgtcctgtttccttcacaccccaagttattctgagagattcttggaaacctgtgacaaaaataacgtctccactcctagcattagagactcttgttttcttctccttccctcctcctgcagcattttgttatataaattaacttagtcttctagttgcaaccagaaccaaaaaaatcctccttttttaggttgaggataaatgtactggcaatgagaggcttctctatggtaaaatctgtaaacatgcccacattcaaagctgttcatcccgtcacacagggagggaagtgtaagtagttcaggttgtctgggcataggaagggatgatcatcaaaggatttaacaactaggacaaggtggataccaaccagccaaaagacatgtccctgagagcagatataggctatcaaaccacattaggacataagggctgggtataaaatcatgaaattataactgtttcatatagacttcaacattcttcctgcctttctgtgggccttccattaggacagtttttggtaagtttagctgatattgacctatcctgtaacttatattcagtattataacttatattcagcaatataactttattgtcttagtccatttgggctgctatagtgaagttctatagactgtgtggcttataaacaacagaaaattatttctcacagttctggaagctggaaatccaagaccagggtaccagcatggttgattctggtaagggccctcttctgggtcacagatgaccagtttctccttgtatcctcatgtggtgggaaagagggtgacagagctctctggggcctcattataagtgcactaatgccattcccaagggttccactcttgggacctaatcacctctcaaaggccccacctcttaataccatcacgttggaggttaggacttaatgtataaatgtgggggggacataaacactcagtccattgtaatcatagctgattgtagctcatcagttgtttgcaaacagtatttctatttcgttagtcctttggcatactgatcttctcctaatgttcagtttttcttccacagtgtattttgtccaacatcattatagagttccatctagcagtatcaatgtgtgctttctctaatttttcattaacatttcttcagcggcttctcaatatttgacatttgtatgcttatatgtttatgttttatgtttataattcttaattccttaaaattttttattgtacatacaaacctaaaaattatttttaggttaataataattactattaacttaaataataattattttaggttaattcctcaattttttttttttgagacagagtctcgctctgttgcccaggctagagtacagtggcatgatcttggctcattgcaagctctgcctcctggtttcacgccattctcctgcctcagcctcctgagtagctgggactacaggtgcccgccacaatgcccagctaatttttttttgtatttttattagagacgggttttcactgtgttagccaggatggtctcaatctcctgaccttgtgatctgcccacctcggcctcccaaagtgctgggattacaggcatgagccaccgtgcctggccaattccttaatttttgattgtacatacaaacccataaattatttttctactttgcacagttacattaaaaatatattcgaatacaatatataaatagaggttcagaaatgcttatagccactatatccactcactacctcactggatcccatctctgagtgtcaatatttatatctaaaggacatgggtttcagatgacccctggatacttgtgcgagggatcagctgtaagccaaactcagtggaacattgtggaaactcacctatctatgtaatacagagagtttctgtccacctctctattgtctggaagtgaagccagctatattctaaatattgtattatgatgtaaccttttatgatgattttccagaatataccaagcagcttttggcatacatacttaattggtcttctcaatgaccctgtgaaatgggtagtaaaagaaataatcttctatttgttaagttctttacaatttgaaaagcacatttcttttttttttttttttttttgagatggagttttgttcttgtcacccaggctggagtgcaatgacacaatctgggctcactgcaacctccgcctcccaggttcaagcaattctcctgcctcagcctcttgagtagctgggattacaagcgccaaccaccacacccagctaatttttgtatttttagtagagacggggttttgcaatgttggttaggtgggtcttgagctcttgacctcaggtgatccacctgcctcggcctcccaaagtactgggattacaggctttgagccacggtgcctggcctgaaaagtacatttctaattacattataacagttgatgactatgttcccatttctgattccttgaaatttatattctagcgtaaatatatctacttagaattccctaaactcaatatcatttttcacatttccatgcttttgtctttgactacctgataaacccctatacattctccaagactttcagggcagggttgattttcatccccttacaggagggatgaatgagaagtcagagaacatgaaagtggctgtgtattcacccgcagaccaacgcctgtgacaggaactcagtcttcagctgtcttagatgactggggatgcccaggacaggggaaggctgggtggtctcaccttctagtcctggataaacccaattccatctttaaagaaaaaaagcactcacctcctggactcatcttctaggacagctaacaaattaccgcaatctggatggtttaaaccaacagaaatttagtctctcacagttctggaggccggaaatccaaaatcaagctgttagccagtgtggtttctcttggaggctgtgagggagaatctgttccacgtttctctcgagcttctggtggttgccagcagtccttggcattttttgacttaccaatgtattgctttcatctttgccttcatcttcatgtggtcttccccctctgtctctgcatccaaatttcccacttcttatgtggatgccaatcattggatgaggacccacctaatccagcgtagcttcatcttaacttgactacacctgcaaagacctcgtttccaaataaggtcacattcacaggaaccgagggtcaggacttcagtgtaacttttggggggacaccattaattaaacccacaacacttcccttctaaggactgcattgccttcttatataagaaagaaagagtgctcagcttgttcttctcaggaacacaaaattaagggcagccacactagactgtgccagagacagttcttaatggtttcactgcattctggaagcagcaagggggtcactgaaggaagtaatgtgatactaccatatctttggatagcaactctagcatattagaggaagaagagcagttccagtatagattctctctaggaatacttcttccctgtcataatgcaaaattcacagtcaagtggcatacagccataacaagttctgtagggttttctcctacccatctaaattcaaccgccagagccactgaacaacagaatcgaagtgcccaatttacataatttgtgtttcacagtcctcgcctctgttgagagaactggatttttctcttcaaaatgaatctcaagagtatgatttattttccttcaagtttttgaaaacgactcaatcaatcctgtttctaagaaatgtccaaatgccaccaggaaagtgagttccgtgtatgaattggccatttggtgcttcctactgaaacattttttgtatgtttaaaaatagctaaataaacttccttctcctgaagccgaggatggaattattgcagtcacttgctgctctgagtgggaacgggacagtctgtgttcatgaatcccttacagctctgggctctcacccccgcccctttcagtgttgagccatgattagggagctactttccagactttaagaagtttggtcttagacttagcagattggtttatcaagacaggcttctccttctccaagttgagtggaaccaaagtattattacctgagcctaaaatacagtgactcaaatctgataactattcttcttactattaaatattccccaagatcttctgtcatcaccatcattgccatcattatcaaaatcacaggagattgaaatggcagtaagggaggtctatggagtatggaaccgtagagctgggttcaaacctggactctgccacctacagcttcgcgaccttgggcatcttggttaaccttgcttaatcctccacaccctcatcctgaaaatcggaggaataacagtatggcagtccccccttatccacagttctagtttttgaggtttcagttacctagagtcaactatgctctgaaaatattataaacaataagatattttgagagagagagacaccacattcataataacttttattacagtatattgttataatagtttgatttcattattagttattgttctcttactatgcctaatttataaatgaaactttataattaggtatgtaggcacagaaaaaacattatatatatggggttcaatactatcattggtttcagacatccactggggtctgggaacatgtccctggtggatatggggcaccactgtacctgtcctgtgaggctgttttgaagattaacctagatagtgcatgtagagtacttaccatggcatctgatacatagtgagtgtttaataataagtgttaactatcataattgttttcatcattgtcatcaccttagtaatcaattgagtttcttacacatccacttgctacccactcagtatccaaaagttggggccaaggctgggggtggctgacgtgcatgaagtcaatgaagcagcatcccttcccacatgttagtgggcactccagcacctcagcaggcttaggttggaacccctggatcttgcacttacactagcaaattccagaagcggccatggatgccagagccacaaaacattaaatcaactgtcaggcatggcaatgagtacctggtggcttccagagtgcatgtgtccaccgtggtcctcacagttggttcctggcagaagttaagaagtaaatttccagctttcttagcacctgcccgttccttctgctgtgacctttcccctccatgccttcaggtgcccggagctcccagatgcccctcctacatcctctcgctgcaaaacataattaaccaggggaaatgtccacgaaggtgccattaaggtgtcctgcaaatatgtatactaaggtgcttgttattcttccccaggttttagtcagagcagtgagtaaggcagggatgaaaaacaggaatcagccaaccagctccacttgttgggaaggcactggctgcagtgctatggatgagaagggttctgaggccaagtgcaggttcagcaggaaagaacatcatgagtgattaacggatgatgtcatgaaagtcgtaagcgattgatggatgacgtcacaaaagtcatgatgtcattaacatcatgagtgatttatgatgtcatgaacattatgagtgattgatatatgatgtcatgaacatcatgagtgagtgattaatatgagcaacttcaagagtaattgatgaatgatgtcatgagggtcatgagtgatgatataatgaaacatgagtgagtgactaatgtcaggcacatcatgagtgatcgatgttacgaatatcatgagtgatcgattgatgatgtcatgaacatcatgagtgaatgattaatgtcataaatgtcacaagtaactgatgtcatgaatgtcctgagtgattaatgacatgagcatcatgagtgattgatgccatggatgtcatgagtgattgaagggtgatgtcatgaatgtcctcagtgattgatggatgatgtcatgaatgtcctgagtgattaatgacatgagcatcatgagtgattgatgggtgatgtcatgaatgtcctgagtgattgatggatgatgtcatgaatgtcctgattgattagtgatgtgtgtcacccacagtcatgggggagcaggtggcagccacatgccatgcatctatgatgtttggtgtaatcccctgaaatgaatgaacacctccacatggtgagacttcagattccatattatccaagatgacatacatttggaagtttgagatttatcctaaaactcaccttgtactgcagaatgaggtgaaggggcttatttttttaagggcctagactcctgaagcattatggccagccaaaatagaagtgacagcatgtcacttcagagaagagaaaagggcatgcatgaagagacgcagattgagactcggttacctgaagggatggaaatggctgtcatggaaactctcctgagggaggctgttgcccagggtttctaactgaagggcacctcttctgtcatacatcttttgaatgagggagaagaaatctccagatccttccagagtggctcaggggtgatactgattcacaccccttcagagtgctggatcaacagtgtaagcaggcatgccctttgcatgatcccaacataggaattaaatattctactgctggtcaaattatttgctaataactcatgcctaaccgtaaatgagtagtcccagagctagaaaaataatacatagtttgcgtcttcattgataaaactgtcttattagcctcaaacatgtagggtgctattgactcccaacagcaaatttgaaaacaaatggtttggttctacaaactagttaatcctctagacatctcttatatcaaaatttccaagaaatttacctcagctgccctttttaattttgaatttatccaagtgaatgtttagaaccggtttgaagctccttggagcattgctggtgtgtttgtaagaacatctgttcagtctctcaaacatttggagccattccctttgaggctgcatgaaccaagaacaaggaaagggattctcaaggcaggttatattgttaatgtaagtgacatgaatactctggaacatgtcacactcttcagtaaatgctaccagacaccacgcaaaccactcatattcctcctcagtaacaaccaaacaaacatcttccatggaaaagaagcttctcactttgccactcaacacctttcccattcctgggcagtggcaggtatgctgaacctggtacgagtgtgcctttctacatcagaggccatgtcctgcagtctttcatctgaaatgtccattaaaaataaataatgggctgggcatggtgactcacgcctgtaatgccagcattttggaaggccgaggcagacaaatcacctgaggtcaggaattcaagaccagcctggccaatatggtgaaaccctgtctctactaaaaatacaaaaattagctggacgtgatggcacgtgcctttaattccagctactcaggaggctgagacaggagaatcacttgaacccgggaagcagaggttgcagtgagctgagatcatgccattgccctccagcgtgggcaacaagagtgaaactctgtctcaataaataaataaattaattaattaattaattcaactcaataaataatgactctagaatgtgtccattccttttatccttgttgccccagctctgggtaataaaagccattttgttactggtcagttttcctgtgagatttcccactagccagttcaccttgcttctgcctgaatatgaccagatggtatttcctaaagaatatctctcttcaaaatggcttccagagcacatacatttctcttttttctaagtaaaatgatagaagaaataaaacaaaaacaaaaacaaaaacaatgccactgggccactaggaaggggccccaatggactaaaatgttgaagaatttttgtaaagtaaacataaatggttcactgttaaagtgaaagccagacacaagggaatgtaacataattggcaaaagacatgattataaaatgaagaccaaaaagaagtttgtttttttagaattctgaattgtggagcacctgtcagagtagatgctgccgcctcccatttttgcccctaagacaaaaggagacttggccagggagacttccagagtggacggtggggctggaaggggagctgtgccgcaggtggccacaaagccaaggccccaagcactgcaagaggccccctcatcccttcatcactgccctgtctccacctggcatcagaatccgcattcacggagggagtggctctatggctgctgaagccatgtgtccacagcctgggccccacctggacgagagtatagccaacagggcaccactgcagcacacgggacacgcgaaagggaggcctcagaccgagcgcctgggaaggaaatccctggagaagcattttaaagatcttgtccatctgctgcagccagaccgactgtaaatatcctccgagagattccagaaggcgtcacctttaccacacagagcggtaaagagtgggctgctgtgaaaatgaaggaagctgactgctcaagacttacaatatttacaaaacaaatttttgtaattcagaagaagaactgaataggtaaagtagtcaaataccccagttgcccccaaaagcctggatcacgctgacgtaaatgaatacggcttcttaattatttctagtgcttcttcccttcacttcctgaagtgttcttgtttggtcaaaattatgaacagaacaacaccagaaagtgccctagaaaatacaaccaaaaggcttcccagaggacccaagaactggacaaagatgaacattcaaacacttttgagagctatgaaaaatagatccaacgaatgtaatctcttggtagaggctttagaaggagagattggggagaaggaagggggaagaaataaatcaagatatgatggaaaaaaactttccccatgcttttgagtcgttagggaaaagaaacctaatgagtgtaattctaagaattttggagaagatctaacgatacatacctcctaataaaacttgacaattcaagtttagaaattatataagattacaggcagggctcagtggctcatacctgttaactgaaccaactaattaaatatagactggccccatgaaacgtgttcttcatgtttactgaaagcatattcttaaggccggtgttggggatgcccttctggctactgtacttcaagatgttctctgcagagggtcatttggaataaattttcctctggtctcaacaccaggaatggttgagcttctcataacctatctaatgggctgtgaattgtgtttccctaaactgtgttggctgctagagagcttagcatgaaatgtgtggcatatgtgggtaggtctttatagcacacatttttaatctttttcctgatgtcttttcttttttctttttacattgttctgatagcctcacttactcattttaagcttattttatttttatctgtgcattcatatcatccttatctgccttcagtcctttttgccactagatccaacatggatagacagataatagatgagagggaaatgactgaccgattgattggcaggtaggaaaattaaagtactcttagcctagcattcaaggctgcatacaatctggccacatcctacttatccagcctcgtaatgacactactcctctatcagagctttcaaacacttttagaggcacaatcagttttcaaatgaaatgttaagtgaatatatatatatatattttttttctgtatatatatatatatatacacatatatatatatatacacatatatatatacacacacatatatatatacacacacacatatatatatacagaaaaaacatggtgttttgttagtattaaaatgtttcctcaagtcaaagtatagcatttgcttttcagttcaatcaaaggaaacagtaagaccattttggtgactacaaaatgtaaactactaattaagagatacaggtccaagttacagcctcttgttaatcaccgtcatcctccaggaaattcacagtaagcctttgcagacccacagcggtgcttccggttaaaagccagtgtggaatacatgtctcaagcttccctgatgttatttctgtacctgtcaaactagcaacttatttaaatatctgatacaacctccgagattcaacctcataaactttctctggtcacatcctcgctccctccttccctggggctctgagggcattttttgcctttacgccgttgcatcttgtccatccctttacaaatgctgagctcccagaggcaagactgtttcactgatatctgtgcagcagccttatagtagactgtcttcatccatcctggcagctgtaacaaaataccataaactgggcagtgtctaaacagcagaaatttatttctcacagttccagagggtgggaagcccaaggccaaggcaactcggtgtctggtgagggcgtgctatctcgctgcgtcctcacatggtggaaggggcaagggagctctcttgggccttttttattaaaaccctaatcctattcagaggcctccaccctcgtgatttaatcataccctaaggcccgaccccctaacactgtcaccttgtgggtaaggatttcaacagaggaatctaggagggacacaaacattcaaaccatagcccagactatgtgtagctgacgctgtgccagattgcgatattcactttgtgggttcaggggacaagaagacccagtgaaagcttgtagggaccttagggaccaaagccagtgacagtgtcagccccccgcccccaacgacttcatccacacctctgctcacagatgcctccctggcaccctctcaaaggccccaccctaattgctctctagccctcatcctgctcctccatcctatttcctgctcttcatcctgttttctctcttgcacgtttcactcctgccattgatttttctgtgtatgttttcagatgcccatcttctccactggcgtgtagttcagtgagtataggaactttgtttgacccaccactttgatcctgacatctagtgcaagagctgtggcatagtgtcctccataaattagcatttttaaatggatgaataaaagctgcactaccatactatactttggggccaatgcagacctaggttagggtcataatcttactctagaacttcctggaaaataagttaatacacatgccatttttaggttacaatgaaagctgcttctcatattgtgagtagccaaaatattctttaagacattattttttttgccctcgtttataaaagcctgctcacaagacctggaactgtgaacactgatttaattttttaaacagaaatgttgtaaacaatgaaagagaatcaaaaacaattaaaataatgcaatatgcagtttgacccaggagtttgatgctgtggtgaactatgatggcaccactgtactccagcctgggtgacagagcaagatcctaactgtaaaataataataaccataatgcaatatgcaattttacaccctatacttaatgcacagtaaatgggtctgaatgaattttcaaagtgaatacatagaccttattggcaactttatatgtgtcttctctattacttcagagggaagtactggtgcctgcggataaagttttagggagacagatttcaacttaacataaagaaaaagtcactaaagtcctaaccatcattgtatggatctcatcgtgtgtaatatatggacatacggtgaaggtggacatgccaaactctcgtcccaggagttctccaggcagaaactagaggaccagtgataggcacatttgtgtaggatccctttttggattattttggactcgatggactaaggtccttgccagtttaagagtctgtgattgttcttctctgatactgactcaatagagcaacttcagggcccattgcagcacccaggcagatccggcaccttctccaaagatccttctctctgctccatgcagtggtgctgatggtaataataaaaaaccgaatgcatggagagatactgaagtgcatcctgaataatcatcaaaattcattgcatgtatgaagtcaaaatttctatttgcaaactttgttgaattacccattttgaaaagttgatctttgtcagtccctcaagacaaagtcaattccattcttctccttagtggctattggtgaaaagtctgtttcttagttgtagatcaggaaacagtgctgcttgactagaggattcctcgccttacacaaagactgctgacacattttggtcaacagtaaaatacctattcatctcttccacccatatttcaaaagtagataacttattccttaaggaatgtttttgttgttgttgttgttgttttgtttgtttgtttgtttgtttgttttgagacagagtttcacttttgttgcctaggctggagtgcagtggcgagacctcggctcactgcaacctctgcctcccgggttcaagcgattctcctgcctcagcctcccaagtagctgggattacaggcatgtgccaccacacccagctaattttgtatttttagtagagacagggtttcaccgtgttggccaggctggtctcaaactcctgacctcaggtgatccacctgcctcagcctcccagagtgctgggattacaggtgggagccaccgtgcccatccaggaatgttatcttaatgcttagtaaaatgaattagaagaggtgggaagtatctactagctcctaacaaaagtttttactttagctatgaagacataaaaagaatcagtcccaaacttaattattgatgctaatgaggaggaaaaagatgagagaaaatcagctgcttccctggctgtgcatttctgcttcagcaattccttgttgtttaagagaaaggtggcaaacgcaggtgcccactgcagccagaaaggaatggaaatgagtgaacccctctttgtgtcatataacggaggccactggagagaacccccggtctctgacaggaaccgttgtgactcagctctggtcagtcattgccattcagaaattgttagattgccagttcttccagtatttcagcagaagtactaaatccatatttccatataaaaatatgatttttaaatgttgacaacccattacaatttgaaaaatatttcttttggcgaaatgaaacacctgcaggccacatctggtccgcaggtgaccagtgagtggtgttcacttgaatcaatataccagatggccaaagaggacttcttcctgtttctcagccttgcttacaagctactcacttggtcattaagaaatcaccaaagcttatgtagccagagggagccataacagaagtggatgtgcttaagtgtcaaggatccaacctggacactcagaaatccacaatactttttaaactgctctgtatgtaagactattttaaatctacctgtactgaattctgagctatgcaacagagttgagtaagacagcgttcatagtaatacatttctcccacttcagcacgcataaattgtcttccaagaaaagggatatttgtcacttattctaccagctgtcagtcagtcttcccttgatgttctgggaagctctttggcacctcagtgccttcgtcaccgacgtgagcatctgtccatgtgaggaaaagagaatgctgccacgacaggggttgtggtgactgttgaatctgcttttgctgcctcagtgttgaggaagccagggcccaggacttgcgcatggctagttaagagtggggtcaggactgcttcccgtgccccaactgccacactgctgtttctccaatgtcattcttctcattcatattctggttaattcagtagctggtcactgaggctttctgtgcttggcacacagcacgtggagaaggaacaggaaacaaacctgcaacattccctaagggaaaggtagaaaacaaagatcagggtcacacatttattctcacaaggcctgttggtttcatgagcaccagttttatagcttctcaaaccagggctagctcacatctaggtgagaaggtagcagatggtggttccagccactcatcccaccacacagaaacttatatcctagtgagtaactgcagaggaatcagtccagaagggaattacttcaccctacgtttcacaaacgcaaacccatgatcattacaagaatgggagctgcaactaatcataaggattgtgagcagttccaatcctgcacattccgagtttggcacagtgtatgagtttaataaatatttgaagccttcaaataggaacaaagagttttatggacacaaaatatgtcttaagtaactgttgagaaaagaaatgttggcttagctttagataaagtctctgtcttcctataccactctttatcttctagacattaaattgggtgtatattcttggtcaatatcccatattaaaaatgtactccctgaaaatattagcatgggtgacattttcctttgtaatcctgattccttggccagtttccttgttatcttcccaactgtctcctagctgaattgttcagtggttattattttacggactcatggagattcacaaggaggaagatgtccatttctccaccaacacccaaaggcttcttgagaacctcccagtgatgaaaatcgagagggtttctatgtgctagagctacaaatcaaacatggaacaacaaccttctcctcggcactgttgtccaacagcaacgacaaagcctaaatagggcagagaagggagagattcgaaaaatgaattagaaaaatctccttacaaagtgctttcttcaggaaatgtgggaccaaagaggcctgcagctttttctcttaatggagataaagtaggatcatccatgtgcttaaaatagtcacatgcagagaaaaatgagcagagacgtctggctaaatgttacatctgctttcactttcattaattttcttgcccagaagaaggtattagttaatgttagacagctgtcgaatgatacaccactttaaacacatttttaaagccactatttcatagtttgtagctgtaagtccatcagagtgagacaacatgaacatgaatatggagaacctagaaacacaacatagcatctatcatagtagacatcatctcctagcacatagtttaagctacgttgacaagaagtgtctgaagtttttattacttgcttctacttagaatggtaatataaactatttttaaatcagatgttacgggcatatgagatacataatctacactgaaatccaccccctcccagacacacacacacacacacacacacacttgaagacacccactggattttgaacatctcaatcagctcttccccattctcatcctctttcttatctgtttcttttccctcttcctcctccccttttcctcccttccccttcccttcccttctttattcttctgaccaattcagtctcaaagcctttagctgggtgaagacaggtgggcatctgcacagagaagtagccccgcatgggctgcctgagctcaagccaggaggtggaggcatctgcccgcctgggagcacctgggctgtggagtcagccctgggcaggaagagagggcgtctgcgcagaggggcagcctgtcgtgggaaatcagagcctaagagtaagggatgcgtctcttggaaaggatggcccactgggggtgtttaagcccaagcagagtgaggagggggtgtctcccagaaaggacggctggcaggggggtggtgtcgcagcccaagcagagtgaggagggggtgtctcccagaaaggacggctggcggggggggggtggtgtcggagcccaagtggagtgaggagggggtgtctcccagaaaggatgtcctgtgggggggtgtcagatcccaagcggagtgaggagaaggtgtctgcaaggagaggtagcagcgatggtgatgaaaatgtcttagactcaggagctagatcaagtaagaacagtaaagaagatgaaaacccagtttctccctgttggggatggaagtcacacatatggggaggtggaaactggaggcacacctgcgtggtgctggactggaactggggggagtggagtgagtccctgtctttctaaacgcagcgctgaactttcagctgaatcttcctgggactatttgcagaactcgaatggggtgtgaagattagcctgtaggagtgcgcctgtgtgaatttcctgaatgtaacggtaatgctgtggttctggaggagaacgccttattcgtgggagatacacagccccaagagcatttggggaagatggggcatcagctcagggattccttctcaaatgcttcagggggcaaagtcctttgccctgtacttgcagctttccttaagtttgaagttgctgtaaaatcttttttttttaattagataaaattttacaaaaatgaataaactgtgtgcctggcaaaggaattgagcgtgaaggtcactagcttcaggttggaaagtgctcttccctgtcaccaagcgtgcagccaccggcaaatgacaaagtcttgttctcaaaaacttaaaaagttttctaaagaaatagctgctaaagaaaatgagaagccagatagaaaaggcattgcctagtttattcttctccatttgagacattttcatcttctctaatatattccagcgggctacattaaacacctaagcagatagaatgtgtacatgttctagtaatcggtatatttatttcatgaaggtcattatgctagagtatgatcattatagttcaggcacaaaatctaaccatgtttcccctgggctctgacccatgcagatgtcagtatgcctccacaaggaccatcttccaggtaaacaggttacacttagctcagctttaagatggccataaatcttaaaatcgtggcatactgacttttgtttcagagtcaactctcagtagcctacacacctcagaatttgttttttagtttttcagccctactttcaattatttacagtgccctgaacatcaaatacagtctcggtctcgtacctttgtaagtcatgctatcatcaataatgcagataattgtattttgaaatgcctaattataattcacatttatatttatattattcaaacacccaatgcatttgccacatgctagacaataagaaaaacagaccaagaggctgagcgcagtggctcatgcctgtaatcccaacactctgggaggccgaggcaggtggatcgcttgagctcaagagtttgagaccagcctgggcaacatggcaaaaccatgtctctacaaaaaatacaaaaattagctggccatggtgtcatgcacccatagtcccagctgcttgagaggctgaggcagaaggattgcttgaacctgggaggtcgaggctgcagtgagctgtgattgtgccactgcaagccagcctaggcaacacagtgagaccctataagaaagaaaaaggaaaggagagaagagggggagaggaggagaggaggagaggaggagaggggaggggaatggtggggaggggagggaggagggagggaagaaggacagaaggagggaaggaaggaaggaaggaaaatggagagagggaggaagggaaaaagagaagaaaaacagaccaagatattagcaggaaagggactgaatttccaagcaaattgggagtcagtgcaagagtaatatcggctcaatggccaacaacaattagatggttttcagcagatgggggctagctggcatcatacgcaagagcatcagtctcagccagatgggaactttgaggttcctgtgattagcttggtaattctaagaggaactgcagaccacttgccataggtaagatgcttcctccatcctgctcaaagccctcccacccttcaccaccaccaaacaccatctctgctcctcatgtggaatctagggccctccacaattgaaagtcagccttccagaagtgcctcctgtgatgctggtgcacagacccctgggccctttctgtttgctgttcaagtctcgagactgcctgtgccctcccgcagctgtgctcttgccgctgccgttctcaccacccgatagctccttcccagactttcaggccgtcaaaatcctcaccttcctttaaaattctctggttcacatcagctttgtaagtatatcctgagcaagtattaagtgatcttgatgatttttttgagtcttccagctatgcctttgaacacgttttcctgtctctatctttttcatcttgaaaatccacattcgctgctgccttttttctgatcacctgttcggtccttacctcctttccatctggcttcctctgtctatcgattgctctcacaaggtctctgctcagccactaattgccacaagttccaggaagaggcagagccggggccaggccaggaggcagaagccactcgggggactggggggccatgccgggggcagtttggtccaacaaagaagcgcttgaaggaaaataatggaaaatcagttctgaaaggtagattgagataagtagagctgtataaacgttgtgacatagataattgtgaataatattccactgtctagccctagaacaatttgactgtccagtggaaaaaccttaccagcaaggtggtttcttgaagaaaaggaagtttgccacacagaaagctccaactggttctaagcaaagggtagcacctgcaccaagtatcagggcatgaacctgcctcctgggttgtcccggccttaatcgtacttcattttgatcagatggcttgcagggttgctgctcacagcctatttctactatctatacgtccacatttgaaagccacctccaagcacacaccgtgcacgccctgtggagaggaagcatttgcatttctacccctcagataactgctgctgcccagttcatgtttcaagtatgagttccttcattctatcaccaggcttaagatccctttggtagatgaactggatgtttacatccattattgctggacagccacagaaccgattctcgcagcatggctgtagttgtgaaccttctccaggattctctaccacggactctgttcttgcctctcaccgtccacgcccaggtgaccgtgtcatccccacggtgagtgggtgccctccttcaccctcagaagccaccctgccccaacgtcagccctgccttagaaaaaggaccacagacctctccatctggaaagacaaagagaccacacaggatgaatccacaccaatccacgaccagtcgtccactgtggagagctctccaggccacctgccaccaagggctttcaatagcagtcaggagccagatgcatgaggctcggagtggctttgatgagatcttcaatcaccggttgaccacacaggccacagtgctgtggtagagaccctccctactccaggggccactgatgtagggttacctagaatttaggcagagctgggtagaaatttaaaaaggggaaaaaaaactctttattgcaaaagttttagaaagggaggctgctgaaaggatgttgattcttcttaagaaaactttctgcacatcatctttgcatttttgtgctaatttctactgcaatttattttctcatcccagcaagtagcaatttcaggtgacgtgacagtttatgaatgttacaaacattatttctttttaaaaaaaatctcttgaaatcagacttggcaatccagatacattttcccattcagtatgagtgggagcattttattagccataatcaagttttccttttcatgacaagaaagcttacagagacctgggaaccactcatataccacggggtttctttgcaattcatgtaactgaggaatcaaacccacatctgcgcctcctctggccttacttattgtcagaaagttcctctcttgtcctgtcagttagagcaccagtaggaactgagctgtgtatagtcagctgctagcttgagattctgacaaatctttacaaaaatacataggcttctatggccctctccttcatcacaagttaaacccacatgaaataatgtattatgagactttgcaaagaagaatgcaattcatcttactgagaaagcaaaaccctgccaggttgatttctttctcagtagcttcgtgacaatttcaaggaagccactgtaccagcacttcatttccctaaaacaggttatgactcttctttccctcatgcgttcggctcagttcctgagtggctgccgtatgccaggcaacgaactgggtgcttgagatcgatgcttttgaggggcttgtgttggagggagagagaggtactcaggaggactgtccttcactgtgacaatgctgggacagagacatgctctggggcctggaggacccaaggaattccacatccatgtgccagggactttgttggaaccaacgataagtatgcatttgcatgaagaggcatcgtgctagacctggggagtgacagacacacatgaagtctctacccaacaaccgatcatggggtcataccattgggagcctggaagctgctggaagcccaggagctcaccatctcccttcccagtagcaaagccaccacccattttacagatgagaatattaagacactcgttacgtctcacgcgagggcacacagctgatcaggagctgagcccacacaagagccagagttcctcccacatccgcacaccccagggcctgtgaacagcgctctgccctctcctgtgcacagggaaacaccaacatttttgctgacacagtcccagaaatctcctccacagacctaagtgtgttgaaccctagtgacgtcctagacacaagagggcactgcagtactgcacatttgtgcttctcctcgcaggaccgtgatgggttctgcaagtgactggtaacttcccagggaatggtgttgcctccaacatgtaaaccacacaccacatcgccactgccacaactgacaatgtcaagactaccctgtggggacacagagaatcgagccctccagttcgagaagtctttctttgggacccaatatttggcagatgccaggcagaatgctgagtttgtggagatgaggacagaggccctgccctcaagtagcctgaagtctaggaaaatgaatcccattgggaaaccagtcaagggacccaagcttggggaagggactagcacgtgctgagacctctgctaagtggaggcatctcactcacgccatgcaagcagcctgggctccgatgcacacaggagcagtgcagaagagtgagggtcccggggtcccagtgccctgccagcatattgtcgtagagacaggcacacacagccagcaggaggacagtcaaaggcagaggatgggatggcaaggtgtttaagaaagaccataagggctgtaggaagccaagaaaaggagtgtttggtaactggtaaaaatggggtgtggggaggaaaaggcagacaacccctcatcgagaaggagcaagaagtgacttctgtgtgccttggctgcctcatctacaaatttgggatagtagtaccagccttgtacggctgacgaagtgtaaattatttattatctgaaacactcagagcaggacctgttgctggtagacggtggtgatgctggaggggatgctgacattgatgctgatgtcatccgtcattgtagctccgactctgactccgtatctcagaggtggggggctctggtcatttgcaccaatttcctgtcatatggggagaattcacctcttgtttccgatgcctggcaacataaattcacatagccaccagttaatagcagctgatgagtttccattctgtgcaaaaaattacactaaaatgaccaaagattctcatagacaaaggaaatttaaggacaaaggaaaattatgtggacaaaggagttttattttctttctgggtacaagagttggtggtggccttagcagaactggatatggaaggcctgggctaggcctggatggtcccggggctgcacggatgtagctcatcttcacgcagacaagaataaggacgcctgtcctctgagtactcactgcccagtgaggtcatcagcaccgtttccaaacagaaacaagatgaagaaacaactcaatgatgagttgtgccttgccagggtgggcggacactcagcctcccctagctcataagctagcatctgtctctgtctccctagaaatcccagctgccactgaggaatatttacactattaacaacagctcccagccgggtgcagtggctcactcctgtaatcccagcactttgggaggccgaggcaggcggatccccttaagtcaggagttcaagaccagcctagccaacatggtgaaacctcgtctctactaaatacaaaaaaaaaaaaaaattagccagttgtggtggtgcgtgcctgtaatcccagctactcaggaggctgaggcaggggaatcacttgaacccaggaggcggaggttgcagtgagctgagaccatgccattgcactccagcctgggtgacaaaagcaaaactccatctcaaagaaaaacaaaaacaaaaacaaaaacaaaaaaaaccagctcccatttatttcgctctaataatggccaagaactgcaaagagcatctatgtcacttaccttttagaaacgacactattgttcacatttcacatgtgagaagagggagactcggagactagggttgcacggtggtgagcagaagcgctaaagcgtaaagtgcaagaccttcactagaccctgcctcttccgctgctgtgggatcgtgatgttcacggcaaagaagtaaagttgaatgtattcattgcagaaatgattatcatttgtgggccagcgactggaagagccccttttctcttgatgtgatttggggccagttgtctacggtctgagaaagactctaggagacactgccgcagggcacccctgccctgcaaaggtttgttgtgatagtgactgcttctgtgccgtatttcgctggcttgggggtgtctgaaaatacagtctaagtatgatatgtaagggaaagggagaatgagaatgacttagacgtatagggtcagtgtgcaccaaatggagctcttctgacatcaccttagagcagtggaccctaagacctacctctagctcccttttgtgacttatttccccacaaaatgtgttaaagtcctaatgcccaggaaataggatcattgtagatgtaactaattaaagtgaggccatactggagtaggatggaccccggatctgatacgaggggtggccttccaagaagaggagaagagacagacacgggaggcagacgctgctgtgcgacgtcagaggcagggaaaggaaggacaagccgcggactgatggcccccaccagaagctgaaagagctgccgccctgcccccaccttcatctcggacttctggcctccagacctgtgagacaatctatttctgttgttttaagctgcccggtctgtgggaccttgttaggacagccttaggaaactgatccagtccccaggtacctactcctccaaatccttcttcaaccacctacaatcctctctgacttaaggccagctgacaaggagcttgctttaaatcactaccttggagcagtggaccccaaagtgttttggtggctggattttgttagagacacacattctcaggccccaatcacaaacccatggagtcagaaacacagggctggtgcccacccgtgtccactttaacaagccatccgggtgattcagatgcagttcagaggctgagagcccagagtgtacaaaatgcccattctttgcttccaagacacacttttcctattttcattttctgaaatcagaatgcctcttaggcaatctctgtaaaatcttatgattaataaatcagtggttcatcttacagctgggggtgtctcagaatcaatgaaaaggaaggaatacaacctccacctgatatgcctgtgagtgctgctttgtttaagaaagcggcttctgatggtggaaaggattcctgtgattttaaagcggtttgtgtcccagcagtgggccctgtaatgagcacctcaggcacactatgaccttcaggaatgttcctccgaggctcccaaaccttccgctcatttctgatgcaccaaagctggcctgaggcctaatctctgggtcccacttctgtttaattaccgcgagccttgtttctgctgcctgcctgcccgccgcctgccgcccggctttcagaagcatctctggttctggaggcttcacttcgaagatgcagccccttgcatggaggggaggcccctggctgggggaaatatgcatttggtcgacgtgttttcttctctctcttctgccagtattttcttctgaagcacacagcactgcctcacccatgcccaacccacctggggagctgagcctccagataaaaatagtgtgcagtttggaggctggtgtttttgagatcgaacagctgttctgtcgcactttcacaacacggttattaaagcaggagagaagtaattaaaattgtcacttgtgcggctgttcgaattatatttccacttcctctccacagagcattcattatgtgttacaaaaatatttcattgtggtgttttacatcattaattttgtttaaattattcttaattgctcactgacatgacaaaaaatgaggaggaaattgggaggaagagattttattttaacaacaaaaaaactggaaagggtgaattttatttattttgattttgatttcacctcttttcgagatgagtttcgctcttgtcacccaggctggagtgcaatggcgtgacctaagctcactgaaacgtccacctccccagttcaagtgatcctcctgcctcagcctcccaagtagctgggattacaggtgcctgccaccacgcccagctaatttttgtatttttagtagagacagggtttcatcatgttggccaggctggtctcgaactcctgacctcaggcgatctgccagcctcggcctcccaaagtgctgggattacaggagtgagccactgcacccagcctgaattttagtaatgagtcctgggctggtgtgggcatgtctgtggccaacatgcacgtacacatgcactcacacatgtgtgcttattcacacacctgcatgcacacacacacatgcatgcaggcacattcacacatgcatgcacacacatgcacacaaacacatgcatacacagatgcatgcatgcataacgcacattcacacatgcacacacatgcacacacacacgcatgcataaggcacattcacacatgcacacacatgcacacgcatgcaggcacattcacatgcatgcacacatgcacacaaacacatgcacacacatgcataacatgcacacatgcacacatgcatgcatacaggcacattcacacatgcacgcacacatgcatacatgcatgttcacacgtgtatgcatacagacacattcacgtgcatgcacgcacacacacgtgggatgtgcatttgggatgggctggaattgagcgcccaggagccacagttcatcccactgctgagccagctctgggggtgggggcaggtagagtgtgggtaccagcatgggagtatttttctgtccctgggccagtgacagaatttgtggcaatttctggtgggcgaggcgctcttccttgttactttttcctcagttggtcttgtatagtgtggccctttatcttctgaaagaatgagactttgtgttccgctttcaacttaaacctgacaaaatctctgtatttctttcacttccacagctggtatggagggaaaactaaaccacgtttactctattagtatgagtatcattgctcatttctttcctttccccagtattggtgaggttttctagaacaatgattagccaagacccaacatctgtgttcatttcttttttctcacttccttttctatcatttccatttcaaagcaaagaaaataagactcttatattcacattcccccaagcgatcttacatttttttaaaaattgttcatttagtttaaaaactgagtaggcagcgtctccacttgcagggcactccagggacccagcagccacgttaggatgcttctcgggtcctgaggtttggttggtggcactccgtgttcacgaggacaggaatacaaggagaaaacagtaagcataatgacagcagtaaaataattcttaaataattcatggaactaagagcttccagctagacgatgtcaggaatgtttttagattcacagaatgttagagcagaaagaagttccaagatccgctaatccaaatgttttcaaacttgttttaagccacagagccccttcttcaaaaggaaacttactgggaagcccaatatggaaatagcggcttctcaagagactctggggactcgctttgaagatctctgatcgggttccattgccacattttgcagattaaagaaatgtggggccaaaaaggttaagtaataagaaaagtctgcttgcaggaaataaaaacaaattgcaccaagagccaccgtggaatagcacagaacgtgtacgtggcttatgtaagtaggtatttgcaggggcttctgtgcaagatgcccaggaccgcagcgggatgccttcgggagcagagatgggatggaaaagccgggcagactctggaaggcagccagggtgctggcccctaaggacgcacgtgcaagaccggataacgggaggctttgtgtgtgcacctggagaacagaggtgcctccttataagtgacctccctggactttaaacatctcacaaaatgtggagccagttctcaggacaacagcacatctggttggccggtgggtccctcgaggaaaagaggatggaagactggcgcgcaggaatgccagtggctcatacctaagaacaagtgttaagaacagaccagttttcatcgtgaacagggtttcagtaaaagaatactcctgttgttggggcttcttatctttcttgaagggtcttccactaaccctcaccaaccaaccatctcaccatatgcccattcgtccacagagccccaggcaacagagtgaatggatgttaatagctccttgattaaatagtaataagaacaagaaatacagataagaatgcaaataataacaatactagacacacctactgaagggttaggagggcatggcacattctaagcatttgatgtgtgttactatgtgatgctcagaacagctctttaagatgagtggtggtatcattcccatttcacatatgaagaaactacagagcagctgattcaagtaacttgcccaagtctactgagctagctagtggtgcagccaacactgaacactcaggtttacttttactttgtgataaagacatagactcacacagggagcaaacggagcccagtggagcccagtagaggactgagtctgtggccaaagtgcctggcttccagtgctggcgttaccacttacagttctgtgcctgtttattcctctgtgaaatggggacgtagcgcctcttgcctggggctacgttaaggaatgaatgagtttgtgcatgtaatgcactgggacactgtggacatgatcagcggggcgggattgttaaccgttgttgttgccattactgttattacggtggtgccacagaggagggaggaggcagagagccatcacagagaagatgctggggctgaatcttgaacactatgtagaggtttagcaggaagactgggagggaagagcgggtgctcaggcaaagaacagcacagcccccacgcaggaacgaggagtccagaatgctgggccacagtgtgtgataggtcaggtctacagaggtcttgtatttcacgtcaagagtttaaacctaagcctctggacagtggaaataactggaggtcccagtcagaggagtgccacatcacaactctttgtaaaccctcgggcaggagagtgggggacagcgctgaggacattagcatggagatgggaggtatttagcaggcacagtgagaggaactaatgaggaatcaagggtggaggttaagagaggccagagcgtggaacgacttccattcaaaaaacggggtttgcttgcgctacatcctcgagtccaaaaagaaaagcaggtgattttgtatcacaggtagcgcccaccaagtgtctgaagctttatgggtcagcccacctggtcatccccattgcttgcaggtagtgacatctcccaccttacagatagctgagaatggaagtcgctaccctcaggacacacacccagcaggtggccatggcgaggtgccacccacattcctccattctgctgtcacacggtggaccaaccatcaggggctaaagaggaggatgggcagcaacctcagcctgcatgcagactgaggaatccacaggaagcggaagcctttccagtctcctcctcactacagtgacctgtcccgtgtccaggtctgatcagatgtgaaagcaaagatggactcccatgtactccatgctcactctgttgatgaaaaggagcctgagtttcccaacacaccataatttgtacacgcaagcgttgtctcgggaagctgagcatttattcccatgatgagcatgtgctcggaagtttttagatttcctcttgtaaaactgtttttacgttccagactcatacggaatatacaactttttacttcttagtatgcttaactgctggcagcgttacctaaacatgaattttatcataccttcattaccaaacttcatttcaatgatcttgtgcactttttcaaaagcaaagctaacctctaacacaggtagctggcgatttagaggctattctagagaatgcgccgccaactctgaactgactctgccaagtgttcaccttcccagggaatgtgcaccacccgcgagttatccacccattcatcctatcggcgactgtcaattggcgacttgctgttaacgagtcaatgtacgttttcctaggtgggatgcaaagttgtacaaaatagattcctatgttccaagtacagttgaagagataagacataactagatcactagaaatcaaatcagaacttaattgctcggatcgaaagtcattgcagaactttgagttacaacatggcagactgtgctcagtgctatgacaatctgagggcgagggtcataccaggagctgcgagaagtatgctgagaaggccgggaagtggggccagacactccatccacagtctagctgtgggctcagtcggggcgaacgaaacagccagtgggcgctgtacctttcccctgcaggcttttgcccacccctccaagcaggctttgcccctctgcaggctttgcccccctgtagcctttgcccccctgtagcctttgcccccctgcaggcttgcctcagcgcacaaaactgaaatactaagttccttctttcatacttggaattctgtgaatcatgtaaaacacctgaaaacgtcactccaaggggcataaaactgatgctgtgagttcaatgcagataattcctaacccctaaggcttttacaaatcaactacccaaaggtacgagctgaattttgggaatgtactgagaaccttctcttttcttcttttttttatgattgggaaggtttcccttattcaaaatgcctatcatgagccctgagtgtcactagtaatttctagagcaagaggttccctgtgactataaaaagtcaacgtgccattgcctccccatcttttgtgagcgtgtaaaacaacccatccatttccacggcccccctcgagccgcgctcctcggactgctgtatgggaaataggatcactttcaagttccctggacacataaaattggattgaagcaaaactaaatgctgtggggcacggagtggagggggtggggacagcctcaatcccaggtttgatgtcagcgataacaaggtttccaaatcaaacggcaacaaaacctgtcggcagtgttgactaggaaatgctgtcctcggaacaaatattttaattatccgcagtagttctggtagcttggctagctccctgtttattagtatgataatatcacctcaatgtataaactttatgcatcaggcatgcataatgcatgaacgggcaaataaagagatctggagcctgttcgcagcgggccatgccaattatctcgctcggccagagcctgcctctgctcacagctgttctttgaaaccattcaccaatgcttaagagatatcagtggtgccagccaggctgtttgaatctccattgtttacatactaggagtttagctgctggttggaaattatctgtcacataaacatcctctgaggatacagacgagaggaagggagacaagccctgtctttatgaattttttttatttattctgatgacttttttcttttacagttttgtgtcctttttaattacttcgttttcctctggaattgtcacatttctccctccagttgagcaggtgaaaactaatgctctaaaatgcctggggctgcaaaccagagacacagaaataaatattttctgttcacaagtctgttgtgtaattcaaagcttttcttttggtaatctgattttttttttatttttgtccctctggtcacaggatctttacagggcaaaaacgaccttatatgtgggttgtgaattcacttgcttccatttgtttattttcccttccaggaacaatataaattttgaaagtcagatattgaacttgagccaaaatagtgtgtgtcaccaaccaaagtttttaaagggccaaatgttgtttttattgcggttatctcttcgtaagcaaaggctgagcagataccatcagttttctgctatcagcaggcgtgccattgtatatttcagtttgaacatcagggctgttgttgcatgctccaaggctgcaccagccacgaggcaggcttatttatcaaggacttaggaaatatgaggaccaggcagagagaatcctagtgaacacgtttttgctgatgcatatgttcacgtgaatttgggaacacgcacataagagtgtgtcattagacaaatgcatagagaatcagatatctaatatttgacctgaaccaggaaggaactcacaatgaaatatgattgtatgctttcatttaaaagcgtatcctaaatacaaaaattagccaggcgtggtggcgcatgcctggagtcccagctacttggaaggttgaggtgggaggatcacttgagcccgggaagtagaggttgcagtgagcccagatagtgccaatgtactccagcctgggcaacagagcgagaccttgtcttaaataaataaatatataaataacagcatatcctatgttccaagactagacctaaacataaagataccagagatattggctgggaaaaaaacagaaaagcaatcccgtgttctcagcctcttttctttcttctttcctttccctcagacttagaccagaacctctttgtcggtacaggcagacaccatctgcttccatcctttcccatgaccatggcaaatgttgacattgcaaaggcagattctgaccacggaattctcatctctggaggaaggtatccccatcacagagagttgtgacgaggttgagagaatgtctctaagagccgagtgcagtaccaggcagatagtaggaaaaaaatgttggctgctgttgtttttgctgaagctgctgttgctcttactaaaagtagaccttagcaagcctgtatcctgcagttgagatccagataaggaaagctgcttacctggaatcacaaaatagctggtcccctgaccccttctttacttacaggagtccccgcatagacctctgaaccatggaccgcgtctggtggttgtactggccacatggcatcaaagcgtattttcatgcaagtctgtcttccgtactggactctgagctccctaagagtaaatgctttgtctatttctgtctgtttccccagcagctagcaccatgccttgcacatggtggcatctcaatacctatttgttgaattacatgcaaagtaaaaaagaaactatgaatatgaattgtcagaagaatagcagctaagtggagtcctaaggtttagccacaagaatctgtgccaaggcaatacagatggattgtcttacaggcatcagagacaaaagggcaaaagcttcctattgtatgaaacaaatcatttaataagttttactgaccagacttgcataagatcatttggaagaagaggaaaacaagtaaaaaaccaatgtggtaaaaacccctcataggtgtccttggtaaaagtattctctgttgtttcagataggtttaaagtgttcctcttgaatggtaccagcttccccaaaattctgtgtatgttcttcgtgtgttcggcatgtcccctcttctctagaaatcttaggtaaatgctaacatgggtctagtctggccaaagtagcacaaattttgagtatctgattcctaattaggattctgcttctgtttccttattaggagaaaatgtattttgatttagagaaattgtattttgatttagatgttttcctgaattatttgccagttttcaggggccatcacagaaaccttgaggcctgtggtggtcctacagttcacatagacagtagtgggcatgcatcccctgggccagagaaaccggatgcgaaggcggcctgcagagccgacctcagaccaccagagggtctgatctcagggcagagactcagttagactgcctgggattaggaatcaacagatacaaaattatacagaggagctgtttttcaacttttgtttagtggcctccttaaatgtaattttattcacgttctttgtattccactagtgtaaagaagtattctatattaaaatatcagtgaagatggcctggttgtcatatggcttcacaaacagaatataattccgatcttagacatggagactgctacccttggaacttagtgaaaagggcaggggattccctatgtacgaacagagagaccacagcctgaattagaaaaaccaggactccaagaatggtcttgagagacctttccttagcctgatttaaatttgccaccttgatatgtcatagccaattataagcttgggaggtcattcattcattaaccattaatctgttcgtcaaacatttttatacaacgctgagtccaaggttcagaacaggtggaggggatgagacatggcttcgtggcccaaggatttcagaatgtgtttgtctttctgtctgtgtgagatggggttggaacacggtcagagcagctatggctttaaaattgcaactcagtgtgacacttgctattattggtacttatggcactttcttcaatcacaaattagaaagcacacgggagaaatacctgcagcaacgtggtaagaaacaattagcttctaaataacataaaaaacagcaatgccattaaagtggacgaaggatgagagagggcagtttgtagtcaggaaaacctatgagaaatgcaaatgtcaagggggaagggaggagggatagcattaggagatatatgtaacgtaaatggcgagttgatgggtgcagcacaccaacatggcacatgtatacatatggaacaaacctgcacattgtgcacatgtaccctagaacttaaagtataataataaaaaagaaagatgtccagctttactcaaaatttctaaaaattcaaacatttacccattagagtggttttaaaaacttttttaagatacaacctagatctccatacactatcagttggagagcaactagacaatatttactaaaatgtgaactgtttcgactttcagtgtagaccgtattattgttccccatgtttcacagcccctccctgtaaaaagatcatcctccaccccatggccatgtggcctgcagggcctctgtggagatacagactcatccctgctctgttgggaccaatgggatgcgtcttggccaacagcatgacatggccatgtggcctgcagggcctctgtggagatacggactcatccctgctctgttgggaccaatgggatgagtctcggccaacagcatgagagtggacatgaactgcaccatgtccaggacattttttagttatgcaaattatttttggtaatatttatttttaatttattttttattgaggtaaaatatacatatataatgtatatataaatatatataaataaattatatgtatgtgtgggtatatatatataatttaccagttttaccattggagtggtaacaaatacatttatattcttttctcccccttcatcgtgcatttctgcaagccccccttgctcatttccttttgttgtgagctcagcctgttccagatgaaggctgacctttcaaccaggatcctagaaagaagacgcatcctggaggatagcccagcagagcacagccgggctgctgcagacctggttaccaggacgcaacattagcggaaagtcagcttccttgtttcacaccattgagagtcaggagttatgtgtttgaaaccacaagattatttcatgaacgttgactataaaacctttttgaaacagcaactgcagtgctaccaactagcttaacgacagatgcagtcttacccgtgtgcaaagatatatgtaagaggtttttcagcaacactgttttaagatagcagaaaatgaaaggaaacaacctaaatatccaccagtagacagacaatggactcaataaattattatatttccatatgatgggatactatgcatctcttcaaaaatgaagttttacaacttttaaaaattatttacatcattgtatattatagtattaacccttctgctactagatgttttcgcttaaccttataatcttcatgttggcccatgtcgataggtgtagatctactaattcattctgcatgctctataatattctgccatgtgagtaactgcgttttattcatttaatctcctgctaatgagtagctgagtaatttcccatttgtgacctgtacatagttgctgttaggaacaatcttctgcctgccttcttgtgcacaggtgcagaggatgctctgagatgtgttcccaggagtggagcccgcaggtcatacgcatgagcatcttcagatgtcatggatattgctaagctgttctccagagtggctgtgcccactgacacccccaacacggcttcaccctcttgtagtggccagactagatgtcaagaccgtaccaaatatgttacattgagacatgtcatatcatactatatatggcatgtatattattatgaatacatagccatgtggtagaaatatcttttaaatatgcagagaaatgatcaacattaacttcaaaatgatggtcacttctgggacgagagaggactgggattagggaaggaatgcaaatgacatcgtagctatttgttatgtcttgtttttttttgtactcaacactacttatttattattgttttccccatattcttttattttgtttggtttggggctctttcatttttattcatcattaataattgcatatatttattgggtacaatgtgatgttatatacatatatacattgtggaatgatcaaatcaggctaattaacatatctgtcacttcacgcatttatcattctttgtggtgaaaacatttaaaactccactcttttagcaattttgaaatatacaatgcattattattacctagagtcaccatgctgtacaatagacaccaaaaggtattcctcccgtctaactgaaactgtgtacccttcgaccgataactcccttttccccacctgccgccccctcacttcagcctctggtaaccatctttctactctttgtttctacgaaatcaacatttttagattccacatataagtgagatcatgtgacatttctcttcctatgcctggcttatttcacttagcgtaatgtcttccagattcatctgtgttgtcacaaatgacacaagtcctttcatctctaagactgagtagttctccactgtgtatatgtacctatgttttaatacattcatctgttgctgggcaggtaggctgtctccatgtctggactgttatgaatagtgctgcagtaaacatggaagtacagacagctcttcaacatcctgatttcaattcctttggatctttacacagcagtgagatggctgaatcatagggaaattctatttttagtttttttttgaggaaccaccatattgttttatgaaatagttttactaatttaccttccccccagagcatataaaggtttccttttctccacatgcttgccgacacttgttagcttttttttctttataatagccattctcacaggtgtgagatgatatcttattgtgcttttaatttgcatttccccagtgattagtgatgctgaatatttttcatgtatctattttctatttgcatgtcttctttgacaaattcaggtcctttgcccatttttaatagggttgtttgttttcttgctattgagtagtttgaattccttacatattttggttattagccccttatgtgatatatgatttgccagtattttcaacacaattcatgaaatgtcttttcactctattaattgctttctttgctatgcagaaatttaggatgatgcaatcccgttcacctagctttgcttttgttgcctgtgtctttggggtccaagccaagaatcattgcccagaccaatgtcatggagctttttcactatgttttcttccagtagttttacaatttcaggtcttacactgaagtctttaatcgattttgagttgattattgtataaggagtgagataagagtccagtttcctccttctgcatgtgaatagccagcttttccaacaccacttattgaagagactgtcctttccccagtgtgtgtccttggcatctttgtgaaaaataaattaactgtagatgaattggtttatttctgggctctctatcctattccattggttgatgtgtctgtttttatgttagtactatgctgttttgattactacatctttgtaatacgttttgaaatcaggcggtgtgatgcctcctgttttattctttttgaacaagattgctttggctatttggggtctttgtggttgcatatgaattttaggatttttctgtgaaaaaaatcaatttccttctgtttctatgaagaatgactgaaatttggatagagattgcattgaatctacaaatcacttttggtagtatggacattttaacaatattagttcttccaatccatgaacaagggatatctttccatttatttgtgtcgtctccaattttctttcatcaatttttatagtattcagtatacatattttttacttccttgaatttattcctaagtatctttttcttgatgccattgtaaatgggattgtttccttaatttacttgtagatagttcattgttagtatacagaaacactgctgatttttgtgttgcattgtgtaacctgcagctttactgaatttgtccatcagttctaacattcctttggtgcaatctttatggttctctttacagaagatcatgtcatcagcaaacagaaaaattaacttcttcctttactatttggatgacttttatctcattttcttgcctaattgctcttgctaagactcccaggactatgttgaataaaagtggtgagagtgggcatccttgtctttctctgatcttagaggaaaagctttcagcttcaccatggattttgatgttagctatgggtttggcatagatggcctttattgtattgaggaacattccttctatacctacttgttgacagcttttatcatgaaaggatgttgaagcatttgtcaaatgctttttctgcatctattgcaaggattgcatggccttcattttgttaatatggtgaatcacatttactgatttgtgtatattgaaccatccttgcatcccacagctgaatcccacttgtttatgatgaatgatcctttttaaaaaaattgtttatttccataggttttggaggaatcagtggtatttggttacatgagtaagttatttagtggtgatttgtgagattttggtgcacccatcacccaagcagtatacactgaacccaatttgtagtcttttatccctcaccccctcctcccctttcctccaagtccccaaagtccattgtatcattttcatgcctttgtatcctcatacttagctcccacttatgagtgagaacatacgatgtttggttttccaattagtgatccttttaatgtaccattgaatatgatttgccagtattttgttgaggatttttgcatttatgttcatcaggcatattagactgtagttggggtttttggcgggggtgggggagtttggtagtctctttgtctggctttggtatcagggtaaggctggcctcataaaatgagtttggaagtactccctcacgttccattttttggaagagtttgagaaggactggtattagttcttctctaaatgttggtaggattcagcagtgaagccatcaggtcctgggcttttctttgataggagactttttattattgattcaatcttcttactcattattgatctcttcaatttcttcatgattcggtcttggtagattatatgtttttaggaatttatccatttcttcttggttatccaatttgttgccatgtaattgttcatagtagtcgcttaagatcctttgtacttctgtgttatcagctgtaacatctctttcatttctgattttatttgcatcttctctctttttttcttagtctggctaaatttttgccaatgttgtttagcctttcaaaaaacaaactttagaaaaactaacttaaaatagagcaatacggtgtgtaatgttaagattttgtaaagcttgcagatatacatgcaaccattttcatgttatttttgtctatgtttaaaatacgtgcttatgtgtaaatatgaccatgtatgtgcagacaaacatttaagaacattttagcaacatttaggttacttctgggaagtggggataaaatagatcactgttactttattcctttctttagtgtcttttagaaacatatattaagtttatgaattaaaagattaaaagcgactaattcaggctcagtagcttttttattgtatggatgagacaaaagacttaaaactatctacacctgtggtttttttcctctgtaaaatatggttagaaatatctactttgcagagctgctgtgaggatttgattagaaattattcataaaaatatctaacagcatgccttttacttagtaggcactaaataaataataattgtttacattattaataagaacataagagatattctgttttcaaatttattcaccctgaaatgtgcagagaaaatacttataggttctttatttttcaataactgattctttcttctacttgagctccccatgggggggaaatgaatcttagagccaagaaacttagtttgactcaataatttaaactggcatttaaatctcttttggtaagtgctgcctctttgggtataaatatgtggactttcagatcgctgttccctcactgggtagggggtgccatatttagcaaataaaaatttaagatactcagttacatttgaattttaggtaaaccacagataatttttttgtagtatgtcccaaatactgcatgggacacacttacagtaagaaaatacttattctttatctgagcaccacatagaaccaggcatcctgcatatcatctggcagccccatctgtgggtgaacagagaggggcaccacgttggggaaaagggccctggactcctggactttgtgcatggggtagagactggatccagtccttgggcaacagataggcctcttctctgatgtccaaggccagcatgacccacagtctgtgtgtctcagctcatctggacctgtggatgggcactggccagaccttccaccttacctctcaagggtagaggactccttgcatttctgccacatgctctttgggccctggactagggtgtccactctggggcctctgcagtgaggccctgaagccctcagcatggtgggatcatagcagattccctagctttcaaccagttgtcagacggcccctcagaagcgtgtggggagttttgatgatgaccgcaggaatactgaactccacccatccccctgcccaagatagtgtgcatgcttcagctttgctgtggccaccccttgtgagtccatggcatcctgggtccatagcctgaagcagagcgcaagcagcagccctggccacagtgttcccacagtgcatctgtctccctgggaccacccacttcccacttcctctttctccctgcatcttcccacaatccacctgagccaaagggacaggctctcctggctctcctgcctctcctgcctctcctgcctctcctccctctcctccctctcctccctctcctgcctttcctgcctctcctgcatgctctgtgctttctcattcagcattcactccacaaacatccaatcgagcacaactctattcaaaacacccttctcaatgcagaaaacaacagcagtgaatctgacacattcttgactgtctcggagcttacatcctagtgcagtagatgaggagaaggacagcaagcaagtatgctgatcattacatattataaggtcccaatagcgtagtgtgtggtaatgagttctacaaagatcaggaaagctgtgagaatggaggctgaccacatggtcatggaggggagttcctttagatgggatagttggagatggcatttgagtagacatttaaatgaaggaaacacaggccatggcagtgtctaggggcagagcatttcaggcagtgagaacaagcggctcagtgggaacaagcctgacatgcctccagccctgcaggaaggccagctagctggagccggtgagtgcagaggacagtggctaaagtaaggttggaaaagtcaccaggcctgcctcttaatgttttcaaaaagatatagaaaataattcagggagactttttttctttctttctggactctccttttgctaagaagaatcgagaagtcacctgcagagaaaacagatcaggggccacctggtcctgagttggaccttccttctcacttctcagggctgcaacattcctgcagctgggaagctgccagctagtgattcaaggaaaaactgaaatatagtttgacattttcaaaatattcctgttacatgaatacgtttttacaaggtgttatgagagacccattggatggagtgacatccttcctggaggagccagcagacttagcactgaggcttgagtaatttataagaacccataaagccatcctggaatgtgtgtctgtatggtaaaaatgatgttatgaggatataaaccaaatgtaatgcttcatagaatgatgttttatggcattacaataatctgaaaatatggactttgagttgggtgtgttgcagttaacacaggtgcagaggtagggagctgtgccttggcccccctgccggcctggcctctgccatcccatcattgattactcttgcatgaattcgggttctccaggctccgcacgtctatctacgtggcataagaaaagcctgttttcttgttctcggctaaactaatggcttcgtttttgttttcttcctggctattctctacccaacacaggtcctggtgttcctatggtgacggtgcacaacacaacagataagaaaagtaagtgctcttttttttccttaaatcttcctgagactcaggagaaaggaagcaaaacactctatgagatcagctggcccacattctcctactcagagacagagggatgagtcatgtcctagcagttcagaataggccatgctgatcaccaatatcaacgaaatatgatgaaagtcaaagtccgcatacccctgccagagggccccacaccccttcacaagtgctgagcctggagggtcattccaggcctacccaggtcatagactgacatcctctgaacagccagctcaaaaggctttgtagcctcacatgagtccgtccccactgagaacctgccatgtggcaccaagacttgaggggcacatggaggctcatctgtctttgtgggtctgggagcttcacggcatggagggtctctgcatccatgctgcacaggatatcagagaaaaacttattctgccatttgtaaaatggtagggaaggctttttcaggactgttgtgaaaggggagggagattcaggctcaactttgaatacagcaagatcccgtgggggtttatagccagtgaccagagaaaggggtccgtggatggaaaactgctaagagaaggcatcagtgggaggcgatttttgctaagctgacctcacaagatccttgctgaaggcaggacaaggacttaggctcaaaggtggaggacgaggaacagttacggagggtgatcagatatcaggggtggagacctcttgctaaagctgggcaatgcaggccgaagacaggttaggatcaaggttgaagcctggtcaagaagaggactcagaggagcctcactcaagtttggtcaaggagagtctttgaaagacttcccagggtcactagaggtggcatgtgtttgcttggagggaccccacacaggttgccacgggcacatccgtgtttacgcgagggatgtgtgctgtgtgcagtgggaggcagaggcacagcacagctgagaagcaaagagaactcgccctcggtccctccctttccagccctccctctgtctaacccaaagcagcctgtgtcctccttcccccgaatccttcccactcccttccacattcaggaaccccttccctggcaggagggcaaacttcatggcccgggtccgcagttcccctaggtctggggacagaggtgactccgtgtctccagtgaccatcgagcatcagcggctccctgattcctatctctgtggtggtacttcaagctccaggagaactggaggcggcggcggtgaggcgcatgttggaaaggaggctccaaacgtgtgtttagacaccgtgaagtggtcaaactgttccaaagtgggcaaaatagattcgtttaaagagacagcacttagccaataatcccaaataatgatgatagtctgccaagctatcaaatcattattagaaatacaaaaccaaagcataagtaatcataaaaccagaaataaattaatagattttaaagcccccacaaaaagccataaagtggatgtcagaatggatatacaaaaacactcagaatggccgttggagggaccccgtgctgagaagaagcgggatggccttcctgtgctcctccccagaggaggggctggtttccccagcaaaaaggttcacctgctcccaggctgctttccagcctcacctgcgaggtttgggaatctgggccatttgagcaatgggggcggtatccccggaaggatgttgggcgcgattgcctgggtctctcacctccccactgcatccacccaccctctgcccactctaaggggcacgaggctgtgaagggccctccaggaggccgcagaggccaagctagaacttccaccaaggcctggggtcggtggagtctgacagacatactccggcatgacagtgaatgtttgaaacacctgtgctagacctctttaggtggaattttccctgaaaaaatgccgatgttgcatagagcctcaactgtgacatcttttttttccttaagcaaatgtatattttcattttgagtatttgataagatttagagtccatggacacctttctggtatttgtgaggttttccccttcttgaaaattgatggtctggtagaaattagataaggtgtccaatggagctcacagcattgcagcctcccgggttagctgttgcccgatggttctgtgagatgccaccactgaagacccggaagtggagacacaggactctatgcactatttgtgcaacttcctaggaatctataattatttcaaatttaaaagttttttctaatctgtggtctaataaaaaacacaaaagtatctttcagctttgaaaaatatgatatagcatatggctcttcttacaaaagtcattcccttaaatgctttttacttctttggaggaagctattattaatctattcaagttcaaaggttaatatagtccctacttttgggaaatgcattttgacttctaagccacttccagcctggatgtgatcagtccttggggctcctaaagcctcccacggtgctggatcaagtcaacacagtttccaaggctcatgtgtgagtgaaaatgaagccggcctgtatcttaggtgtgtgtgacactgttgagaaaatatttcatttattccatttataaaaataaggtaatctataggtgggctgaggtgcaattcttcggaagagagtcccagtaagaattgaccaaatgtcttccagcaagtgcaacatgctaatatgctcaaagatccaggaaattttgttaactctgctgggaaacaaaacaaccacttcttttcctctgtaggactggctactacattaaccaatcaatccaatcaatattgacagaccataggccctaggttgccatccatatccgttgcggagctgcataaatgggaattttttaggaagcatttcgccgtttgcagttgagctgtcactttggtgactgtgactccctgaagcaaagagatgggacccagcggcttaagaaataaaaagcactgtgcacacaggatggggctggcgttacatgcctgtactcccttcttctctgtgtgaaatttaacagtgaacctgaaggtgacaccattgcgcttgatctcagcaaagtgctgactaattggaaactggacggcgtttagaattattttggtcacatttattttacgagcctatttatatagcagtgtttgactctgggtttcctggagcctaattcaaactctaggaatatttcatcccgccctagcctgtttctgcatttctggctgtcaatgtagttcaagctctttcaggatggtaacttaagctgccattttaacttggaaaaaaaaatgattaaatgtggttgagttgattgtcgttcccatccccaggaggacagtaggggtcccatcttgctcagtgtctatgttacattcagacttcatgatttgaggggttccaggttcctgaacacccactttttccccatgcctggataaaagtgcctgaaatcccttccttgcacggccatccctgagggttggcacatcatagctgcacgaatggctttgagtccacctgggaaataagagtgagtgtggcagggcctggtaaagtgccaaacccagccctgagttccagcctccaggtgtttgccatgggaggcgtgtggggtttcttcagtgtgtttaccttttgatatgtctgatgtcctcttgcagcacttcacagcccatctccaacccagctgtgtcttccccaaacaaaatgcactgagttttcattttgtctgtcaaactggtgcatcttggatgagaaggcaggtgcctggtgcttccaggcccccagttccagcagcatcttgttcgtggtgtggttggaccacatcagagcctcctcgtggcctctgcagtggatgaagggtccacagcatgtggtttgcggggggatgtgcatatcaggcagccgacaaagccattgtcaggccagcacttcacacatcagcctttgggcctcaggtaagcttgagatcagttgtcctctttcacgattgaaaaggccgctgaagacttccaggagcaacacaaaggcaggcagtgagtcacccatccctgcagatgcctgtttcatccaaacactcagccagctagcggttctgcatcgtcaggattctgcaaaaccccacaccacttgtacttgttccatttgatgctccatcctgaacaactcagacaaccgtgttctgatcagggggccagagaaaggctggaggtcacagggagccatggtagtaacaatagtggccccaaccagcatttatcagcacttgctccggggcagggtgctgtggcaaatacttgacatattttaactcatttcatcctctcaacagcctgtgaggcaggaactgctattatccccacttgtcagctaaggaagctgaggcaccacagcttaggtgatcgggccacatgcatgcagcgaggaagcaaaagcagaggagttgcatctcggacgcaagcagtgcggctccaacagagcctgttcttccagacatgtggtcattgcatggcgctgctcagccgcctgccctcatgcggtctgaaggacaactgcaaatccagagcgatgcccggcctgcactcccattgagatgagtctggggaggcagaagcagtcacacctgcagctcgttctcagcaccttctccgcccatacaccacccccggggtccatccgagccagctctggggtgagcgtgcggcacggcaccttctcctgctctgagaagccttccacgtcacagggaagagatgctcctcaggccctggtggctgttaaacctgtgggagccccgtcgaattaagggctctgcttcctgcagcagctcagcctccatgtgcaggctggggtcatactccatgcactgtgagagctcagcccttgaacttcaccctctaatggcagccccttagcccccaggcagcagtctttggctagccatccattattctcttttgaatgtaatcgtagcagcagttctgggctctccacacagcaccaggccccttccttgtaccaaccctatgaggttcaacaattcatctgagatccacagcaaacttcagggcgaggcccggactcttgtcttatctgactaccaagcaggcgctcttgactgtgggctgggggctgataccagatgtctgacaaggggggaaaggcagccccagaccccaagacccaggatctcctggccttcacgtcgctgccatctgggaaatgtgctcacagcagcagcctctgtgaccactgagctgctggtcaaaaatcacccctggtttagatcagccctggtgaggccatgccagcacaggcatttgcacctcacgcctctgttgaacagtgtgcaaagcagcagcgcttccaacccgcgctgtggggctgagccaggaaagcggggcccatggcctacagctgggcagggcaagacaggaggcctcggggagccggctcctgagccgctgtgtgacgccatgactggcagctgaggtgtggcccacgttctgttacagggcagagcctcggcactgtgcgtcagctagcaaagggggctctggaaggctgggacccgtctttatcatactatcctctcccagccctgctgtgaaatttgaaattactgtttcagaattctttgtcctttcccctcctctcccccactgaccccaaaaccaccctgggaatatttgacttttttcctctttagaaaatcttatctacaaacagagcctgcggggtgttcacagatgtgactctgaattatttaaaagctgtttccttaagaaggtaattatggttgggaccaacctatactcatttggtgcctggatattcaaacaaacaacttaggtactgggataaaaaaaccaacaaaatcatagtgaatacattgcgggctttaatgtaaatatgaaaggcaggcccacttagagacgtggatgccaactcgacgtgtgggagtcgaaattgcggtgtggcttgcaatgcagccccacagccatgcagagaaagcgtgcgtgtggcggggttgaagctggctacactggctgacagcaccccacagcggcctgcaagcgcatgtgggagcttgggatcactaggcagcctggttcccactcctttatggcatcaaaagttaggtttctctacctcctactctcttcatttgggtctttgtaagaaagcaaaaacagcccctaccaccagtggtgcccaggtgggtccatgaagcaacgccagatgcagttggtttccagcctctgttcctgcaccagtgctgctgggcgcacccctgccccaccttctccctgaggcaccccctcctagactgtcaaggctgtgcccacagctccccttccatcaagcacagggcgcccacacatggagagacatcaggagcatggcattccagagggcccacatgtcactgtcacgctacacgccaaggagtttgcccgccatcctgcaggacccaggaggagcactgtcagacgtccctctcgaaaagcttctggtcgctgtgcagagaatggatggaaggaccccaggttgcagacaggagggctgctgggggccatggtggaaaggatgagagtctggaccagcaggggggcctccaatgaggggctgcctctgcaggccctgcagggagagatgcacctggaaaggggccgaagagctgccatctcaatccagtccagggaggtgtggcacttgctggggtggcgaagcatcatacagaatcctacagcctgtggccctcaaaacctgggtcttgtccagtcctaacaaagaaggaacagccccgctgcctccttgggtgcagcagcaggcgactgggtgggtgtctggagagtaggtcctcatgcctctcaccctgcaggccaactgggcaaagccctggctctcagaaacagtggccaggacacagcgggcagctgccccatcacagccgtggagccaccaccaaggttggggccgtccagcaaatgcacaaacccatttcagacctggagataaaagccagctctttcctgcagatcatatggggcagaaccaaaaagactaaaaatgtaaaaagatgatgaaggaaagtaaatgttaaaagaaaaaaaatttcgaaagcagcctggtgcctaacttcagccctaggtcttaacatggctgcatcaggcaagtttctacctaagacccacagctttcaaatattttaaggagcaatttggtggccaaagagagaaagtctcattataaagtggcctttatgtgaggggaccttgccaagtcatgccaagacagaggacactgggccatctgtcctcaagtagtttttgctcatgaatccctaagataatttttgaaaaatcatgtttcccctacacatttttaagttgtcacctaaagtttttctcattaattcaaagctgtacaaaataagtttttagcatatttattttaaaataaaagtattacataatcctatgatatctaagtattgtggcaatttgatacttaccactgcccagttaaacatttctggaacaagttcttcttagctttacatccttccttttcctcctcgagctgatatttacattccatttgtccgcccgtcaccccagaattctgtcctaacgtcatttaatcttggaaatattttaaaggtcttttctttttaacttccggtgaccataaggccataatcattacttgttggatggaattattatcataattatcacttgttcacatcaagcaattaggatacattacatactttgataattgttggacataaaaagttatgattgctctgagatgcatctcttagcgagctgggtgtggtggtttttcactcagttcatgagcacacctgactcatttccagagaagaccttgtcagaaacgtgtgcgctcctggtttttccctccttttggtggtcgcttctttttgtttctgtagaatgtctgaaaatgtgttcatgtaaataaatggagagagaggagtcttgttatagcagtgccattttcactgaacgcctgagctatatgccaaaacattgtggcccatccattctctgtcattaaggattattttcaatgatctattgatttttagctcagtgagattccccttccattttgttaaaatcaaaggatgacaagccgaccatgttactgggggctcttacccattactgggggagttctcttactgaactcagccttggtggtccctcatccttcatgtggagcccacctgtgtacaagatgccccagggacagatgagggggctccaaggccttccttgccctcgtgacgcctgtgtcaggccatgatgaaagaggcacaggaaaggagcagttccttggagcgaatcaggcatgtccattctcagcacatttgccagcaggctcctatggatgcagagagcctgggaaccagtctcctgaatcccacgtgtctgcactcgaaatcttctggacccacagggttgcacgcgtgagcagctgtcctggtgggtggagtgtctgcagatttgctgttggaacgtgttagacttcagtccagcatttgggtgggcaagctggcatttggctaacacagagtggaaagcaagccacgcatggagctgcacgccctgcaggatgtctgcaggtgcttcttcctctctactacctaatgcgggaggagagctgggcttcgctgccacccagcagctctcggtgcctcgaggagcacctgcaggctgggcactgtgccagccactgcacccgctcatccgtgggctggaggacacacacatgagtcccctcaatgcacaactcctctggcatcaaacacctgccatgggcccagcatgatgctagaaggaccaaaaataaatgccacctactgggaccctgccctcaagttgcttaaaatctggctggaggaaaaaagatatggcaaaaagaataatagttgcccaaactgtgtcagactgactctaacaactcaacattcggagttcagagaaaagaggctgggtgctgtggctcacacctgtaatcccacgaaggtgggaggacctctttttcttttttgacctcctgggctcaagcaatcctcccacctcagccccacaagtagctgggactacagacatgcatcaccatgactggctaatttttacatttttctttggagagatcaggtctccctatgttgcccaggctggtctcggactcctggactcaagtgatcctcctcccttggcctcccaaagcattgggattacagacgtgagccaccgcacccgaaccctttcctttgtcttttctattttgttcataaagcatgtctctgttgatcactgcatgtatatgtggagggaaggacaatatgattttaagaaatgtaatatttagcatcttggccccaagattctacaatcctttcataggatttttttttttttttgagatgggggtcttgctctgtcacctaggctcaaggggagtggtgcaatcacagctcaagctatcctcccactgcagcctcgacctccagagctcaagctgtcctcccacctcagcctcctgagtaactgggaccacaggtgtgtgccaccatgcctggatttttttatgtttatattttgtagagatggagttgggattacaggtgtgagccactgcacccagcaaggaagatctcttgagtccaggagtttgagactagcctgggaaacacaatgagaccctacctctgcaaaaattacaaaatttagccgggcatggtggtgtatgcctgtagtcccagctgctcaggaggctaaggtgggaggattgcttgagcccgggtgttcgaggctgcagtgagttatgatttcaccactgcactccaacctggctgcaagaccctgtctcaaaaaacaaaaatggagctcagagaaaagagatttccagttaaggtgagtaagtttaaacagtagtcatgcgggctctgggcctgaatctggtcttcgaatatgactaatggcctagccctggggtaagcggacggcagctgcaagagcacagggagggggcgaggtggggcagagaggggtcctactgatggccgcaggggaaggtgcacgtgaggagtgagcagaaatacagcaggagaggcctggactagaaaggcacagaaaacccaggcaggggaagtcaggccaaggcaacagggagatgccggagagacttctgcctaagcctctgcgtgcacacaccatcctgcagttttatttcttgtagaaatgtgagaaagggaagcggctgctctctcctcttttagatccgttgcctattggtgttcattggatctggtcaccaattttccaaaatttagcacagtggtgattccatcaatcccctgaacctgccgggccacttggaagcatgtcttgcaacagtgcacagctacaccacgacctgcccatgggacgcagcgagggaagcagcctcatgagcaggcctgagtctctgcggtctcactgtgtccagatctgataatagctaattccaccaaatattagagggggctcacatttaattaaagagtggccatttgtgtgctccagactggaggtccccactgccctgaagtcaaaagaaaagtccttcagggaatatgccaatcttttcttatttctctgctgagctcctgccctctttgaatgcaattatgggaacaaataaaatggcttaactcaagtcccctgtgggacagtcagctctctgctgataaaaccagttgtgtgggcaatcattaaatgagaaatctaatatttaactaaatttaatagtctgttgctttggtgctttcctgtgaagggtgggatttcaatagagaggaacgaggtattcacacgcagcctgtgtagtccatgagcgattagaacatggtgcgttcccacatgaaaccagaactctcagatccggaaactggtaacgggctgtttggtggccagcctgtgttccgttagctctaggcaagcttaactcagtaggcagcagagaacattgctccctgagtttaaccttctccttcatgaccagcatttgagatcgcacactgacggctgaaacatcaaattcacatgcatatatatggagacaagagcgtactttaaccagctgtaagagggtctgtccccattttctctcagtttgagatttggccatccagacaggctcttgccactagcagacccccccagctgaagccctttctgggacccagaagcagaagctaactgatagcaagaagcccatctctgttctcattggtagggtctttctacctttgctcctgccagttcccctgatcttcatcggttgtcacttccatcatttgacccacatttgcacaccccaagttcctcacctgttttgcacctgggatgatcatgtcagcaggcagaggagcagagaccacaggttctccaagggttacagctgaggcgtcgagatgacctcatgagatcgaggcactggtctcctacaataagctggagtttggagcgtgtggatgaactgcctcatagtcccagagtcgagtgaattaacttaggtgcatcattagtctcctaaacatcagaaaattttccatcaacttctaaacaccagaaacttttccatcaacttctaaacaccagaaacttttccatcaatttctaaacaccagaaacttttccatcaatttaatgcagtttgctttgggtcctcgggtctgagctgtgtgggaaacactggttgatagtctggcctcagtttttccaactcttaccgttcaagagatctgagccctgaagacctttgcagcttcctgagacactcaggaggacctctcctcggtcctgtttagtttcctggggccacatgggaacaaggagaaagacttgggtagaaacccagactcgttaccatctaaagatgcttaatttccaagatatgaatcgattttccacaaacccatctaccccgggtacccaaaactagtgcatttcgtctctgggataggactgaacactgataccttggcgaggggtagggagaaggatttgctgccaggaaaatgaccaaaactttcatttggtgttaagtgtatccagagagcttgacaggtgcctgagatagggtggtcaggtccctcttggaggaggtaacgcttgcgttgatggaggagaaggagctagcaaggaagatttcaaacacagggcagcacgtgcaaaggccctggggcagcaaagagcttgggaaatgctgttctcttcattaccaggcagcactccctgctagtcttcctttcctgtaactgtgaatagaacatgaatgatatgcagtcactgtctcataaaccaactcctctcacctgagtgtgtgcctggagcattgcattaaagggctgagggcatttggactcagcaccaatgagtgctgccgcccatccattaggaacatgggctgaggctgtgaagctggcgcaggggcatgcaggccccttggggtggagtgcacctcccctaactcacgtgcatgcctgtgagggagagtgcgccacctctgcagccaagtctctgggtctcagagttaaggtcaagtctacttggacttcccttggacttcaccactgcagacaccccttgcagacgtagctgtgtttcctgctgggacacgtgtcctgcaagggacacgtttctcgcatgctacgtggtgttcggaacctttcccagtggtggtctaacgtcagatttgttaaaactctacctgtttgaaaactagtgtcactatttctccccttattttttatcaaagctcaatattcaaatgtgtccagcaacttgcaagtcattttcattttatgtactcgtcacaagcgctgggagcttccatttccccctgttcctctacagaaggttgccaggccttctgggcagagttcttgaataaagccacagccccatgttctccacacaaagccacacgtccagattctcctagttatgggcggtcatttgacctccagctgccccggagaagcgcccacctgcagagcagctttttttttttttttcaagggagttatatgggaggatgactggacatccattctagcattgtttgtgatcatttgtttacgctttaaacaaatgcacaaattgcagctgcttccaagtgatttgacgagccaaaggcaaagttccttgcagaaaaattccctttcacaatgaaccacaagttatccccatgtgtaggcttagtgtgagaagggagaaaggaagttgggtggtttttatgacacgtcagatggtgaaatgaaacagaatggccatttcagtacatgaacggagagttcctcaggggacttctttgcatctgaagaaatagataacgaggacgtgtgtgtgctgtcgcggcagaggcacaaaggtccagcgcatccacaccacagggcagaactgaccttggtctctaccacggagggaggacagccagtcccactgcagtgtgaagcaaggctcacacgactccactgtccacaaatacagtcaccgaagttaaggtctctccagagaccagcttatcttctgttttgggagagagatcagaatccattttatttctgggaacatttaataaagatgataccctagtttctacccacctttccttttctggttattatggccacaatttttggaaaaccatttgtcctaacagatgtgtaatgtaggttttcttaaaaccagcagtcatgggaagaatcataccaaaacctgtgcgtgtgacgccacggagaacaaaaacctctggtgggggaaggagaaagcctaagacggtggggagaatctttaatccacccaaattccagatttgagtctaggcttttgagcgcataacttgagcgtgttttttaatgcccagtttctttttctgtacactagaaataataataatcacctctgaggctgatgaaagcagcagttacgcacatgaaaagccatggcccgcagaggtcctccatgagtgaccactgcatctcagtgtgtccctgtttcctctctttcagaaatgtttgacctagaaacaaatgaacatgtcaagaaggccataaatgaccgacagatgcctaaagtggaatacagggacattgagattgatgattacagtaagtactacgtttttcccctctaaaagaaaaagaaaaagaaaacgtgggctgtgacacagtgcagtcatcagcagcaggtgccctgcaaggaagactccccaagcacgggggtgtatctttgcccctcagctcctctggcatggagtgtcttgtgttcagaaccaagatgctcactctggtgacaaaaccaaaaaaagcagggcacaggatctctctccctgagaggctgacagttgcttcaaagcaagaccacagactccaacgctctccttctttggtgaccgtgtcaagacaccgtccagaaaaacctcttccctctggaaattccctttctgtgccatctgaagtccttcctgcctcatcagctggtggattatgggctgatgaggggcgtccttgcagccagggtttacgtgaggaggtttgagtgctgttactccctaggaaatgcttctcactctgcctttctctgcctgtgcccttctttccttgaactgtccctccagtcattcggtaagttctcctgggcactaactctgtgctaggcgttgctaagcactaaacaccccagagcattagctggacctggactcacagctctaggagggaggcagagcctcggagcctcaactcccacctccgcacagatggctcccaagtcacccggctggccccgtgtcctcactgcccaccaggtcgttactcttggaaacccaagtgtaaaatgcccacagcggatttcactgtcttcccccagaactctgtcccgctccagacttccccacctctatgcatagcagccttttggtggtaagttggtgtcgaataactgagacttcaaaccttgaagctgtctttgagtcattcatgcagacaccacttacccatcacctctgaggctgtaaacgggtttccctcctgtgcaaactccgactgactgatagtaactgcaggagctctttgttgaaagggaaggtttccagagctcggcggaaagcgtgttgaggctgataagtaacactgagctgaaagggcagggggaggagccacacaccttgcgtttgccatccctagaccgtctctggaacctctttgtctgcccttccctgacacgagacagcagcgtgtcgcctggagcctagggtattcgctggcagcccccttgtgctcagcagcttagaggagacacaatcacctaacagactcagctcccaagagcaggtaccaaggctcaccccacgaaacaaaaacaggtcccccaaacagtacgtgctgcaaagctgcattgcgtagagcagaaagtaaatagcacgagaattcagagaagagcatgagactgggctggggacatgtgggaatgctcacggaacgtgggacttgaacatggtccctagagtcagcatcaggtgggctcacaagaggagaccgtgcaatccagagaagagggcaacgtgaggggtcttaggcaagggcaagtgcagtgcagtgtggctgggtctggaggctgccctggagtcccagcctgcaggacagcccaggtgtgggccctgcacagggaccctcactcgcctgtgctcaccacgccctccctgcagcccaccacaggtccgggccaaaaacttctggccccgccatttggccacaggaagctatgctctatcacaacttttctggacattgcattcacctctgaaagtcagaacattctggaattttgatgcacttcagatccgctcccgcccccacccccacccccacccctgcccccaacacactcacatgtccaaaggctgtctctcttaaaataccctgaaggtgaccacgccagggaagggggcatgaacgaaatgagtagggaatggtctaggagaaaaagaataattttgtgtgtgtctgtgtgtgagacagagtctcactctgtcccccaggctagaatgcagtggtacgatcttgggttactgcagccttgacctcccgagctcaagtgatcctcccacctcagcctcctgagtagctgggaccacaggcaggccacatgcccaactaattcttttttttttttttttttcgtagagacagggtctcactatgttgcccaaactggtcttgaactacggggctcaagcaatcctgcctcagtcccccaaagtgccaggattataggtgtcagccatcatgcccagcctagaggaggaagaagagaaattcaagaaaaccataaacaagggctgggcatggtggcttatgcctggattcccattactttgggaagctgaggagggcagatcacttgaggtcaggagttcaagacaagcctggccaacatggtaaaaccccatctctacaaaaaaatacaaaaattagccaggcgtgatggcatgtgcctgtagtcccagttacttgggaggctgaggcacgagaatcacttgaacctagaaggcagaggttgcagtgagccaagatcgcaccactgcactccagccttggcaatagagtgagactttgtctcaaaaaacaaaaaacaaacaaacaaacaaaaaatggaggctgtgacaagctgctttggccaagaaatgtgtgtattggccagtcacggtggctcacgcctgtaatcccagcactttgggaggccgaggcatgcggatcacttgaggtcaggagttcaagaccagcctggccaacatggtgaaactctgtctctactaaaaatacaaaagttagctgggtgtggtggtgcacacttgtaatcccagctactggggtggctgaggcaggagaatcacttgaacccaggaggcggaagttgcagtgagctgagatcgcactactgtactccagcatgggtgacagaatgagactccatctcaaaaaaaaaaaaaaaaaaaaaaatgtgtgtgttatcccagcccaatggagaaaccattgccccggcatgtctctgaagctcctctgttctcagctcgaggctcctccgcagccttggcggccagactgtcaccctggcaagatccctttctgagctccttaggcctggcctcctcctcctccagcccactctacccactgctgtcccagtaacgcttcccaagcctgcagcactggtgtgtgactgtcatcccttcctcttaggaaatgcagaaaagacctttcaaagcacaaagccagctttcccacccttgccacacactctgtccagcagggggtttccttaaaaggtgggtgggtacagatgccaggagaggatgtggggcacctgtatgagcccagcatcaggaagacccccttagggatcgcaggaaatctgaaagatgtcagccctaccgacctgacttggttttgtttttttactttatgctaccagaggctaatgcttttctttattttattttattttgtattttttagaaaagtaggacatcttccagaagggctcccctgaaatgttttcagccagtcagaacatggtttccaaggtctgcccttgggcttatcagtggcagggagcagcccagaccatgttttatggaatttaaatgatgaagtccaaggcctgcctctccgccagtccctgggccattgagctaatttgcaagccattaacattcagcccgaatcagtaatgagacgccaggtcagagctggctgcccagccagccacccaagcctgcagtgtatctgtgtagtaattgtattgaaaagccgctaattccaatttaattgctgtgcctttggtaatctgggttgtagttaacatcaacaaataaattcaacttggatgggaagatttgttggaaggtagggggcacagaagaaattggtgaggcaggtttttgaggtttggttcctacccactctccctcacccactggatttcatgctgctgaggaccagatccagtgaccttggtagccacgggatccaatgggctgtaccatccttccctggcttcccctagctgtggctgcagcatagccatagagccacccagcacaaacctgccaacagcaagacccacagatccacctggctctgcacagaggcactgccatgggccggcaccctctcccctctaggcggccccctgtctcccctgaccctctatctcttcctctccctgcctccctgctcccaaatatccatccccagcatccccgatcagatgctgagagatgcctttgttgccgcaggcagccctcctgctctcagggcaccatatttccctgcctgaaattctgctgctagcgagtgcccgggccatcgagtcttccgtgcattcagtgcactcccatatgcaagactgaatggaagcttcagagaaatgaagcttcacacaggtcgggtgacttgcccaaggccgcgcagcaggccagagtcctcaggatgaaaaccctgggccagtctctgtctgtgggcttcccctcaggccccacccagagcaccctcacccccacggtcacccaagggcatgcccgataccccgtggccagcattgccccctaacccgtgctgtgctctgcttctccccagacctgcccatgcagatactgaagccagcaaccttcaccgacaccacccactaccctctgctcctggtggtgtaagtatcgtcacatctgtctttccctggtgctcgttctggggctccgtgacacccatgataaaggaatattgaactcttaagaaaagataagcaggagaaatgacattgttgcaaactgaaaacataacatcgtttagcccaatgtcaggttctttaggaatcttggagacacccagaggttaaaggaaagtgggtgctgtgtacccaccgcctctccccaggctgcctcaggttctgtgaccataaagtgaggctgctgggatcatcgtagtggcattttgcatgacaggctcaccggaggctggcaggggacaggtcccaagacacagagacacaagatggctggagcctgggacccgcaccctgagcccgtgggtctcactggctggcatttctggccactgccgtgaatgcccttttttcaccagcaaagaattttttcagctctttcttatattcattaataaagcctccggtttgggttttgagaacaactttttgtgctctgtaaatgccttgaaggtgttgggtctgattagggaactcagtgctaggagccggcccagtgccctgtgcataggttcaaatgttgcctgacagccctgagtctaggtgatgtccacgcgctgacaccgcacggggaggcagtgcagagggggccacctggaccgttgagcaaatgccccaatgcacctcctggtctgtactttcaagaccacggagcaggagaaactcctgcacccctcgtagcctgggagagccggctgaagcgaggcctatgctgggctgtgttaaggatgccagtgcaactaccccctgagtaaacgctggcacctgatggagctctgattaaccctggtgtcttgccctgctcccttcctgagggctgagtccctaaatagcaaaaaggttccattatagaaacgccccagggcacagattccaatagctgattccgttttgcaattaacccactttccttaatatctggactgctttcacactttcccagcagccatgcatgcacactcacccacatgcagacacacgcacccacacacaggcacacgcacatgcacacacacccacatgtgcacacatgcatccacacacacacatgcacacacgcatacataaacacacacatatgcatacccacatgcacacacacccacaggcacacacatgcacacacacgcacccacacacataggcacacacacatgcacacacccacatgtgcacacatgcacacacacacgcacctgcatacataagcacacacatgcatacccacatgcacacatacacacacatgcacacacatacgtgtgcatacgcatccacatgcagcacatatgcacatgtatgtgtatatacacatgcacacatgcacacatctatacacacccacacccacagacccacacaccccacacatgtgcacacacaccacacacgtttcctgcctcctttctcttactaaaccagattttccccactttctccaggatgctaacaacttccgaaccagctttcttcccctgcacactggtttcttcagtgatcttaaaggaaatccccaaaagcatttcagtttacaaaacaattctccttcccttcagaggtaaaagtggtcgtgcccggtggagacagctgagctctgctgagctcggacgggaccggccaggcaaccccaccccctgggtgcacactcactctggccttgctagcttgccttggaggctgtgtctttttgtttgtttctcactgtgacatcaaatgtgatagcaaggagatctggagtccctgagcccctgcttcagattaaaaaaatccaaaagaaaacaaaggcacactcgacatagagcagcaccatgactcaccaggaccctaagcatgcagcactcgagcgcgccgctcctggcccgctcctcctgcccccaccccactcctcagcccttggcagacagctgggagagtgcccgtggtcgaagcagtcacctggctggagccactctcagttggggcactgctccctgctgttccagggaggcaggctggacctggggctgactttctctcctgtccatctttttcccggcaagagggaaaatcacttaaaaacttccccacacccataagtatgctggtcaatgaggaacaaccagtcctgcatagaaaatggccctgttcccagcctgggcaacatagcaagaccccatctctacagattaacagatttttcttttaattagccaggcatggtggcacatgcctgtggtctcagctatttggaaggcaaaagtgggaggattgcttgagccccagaggtcaagcctgcagtgaaccaagattgtgccactgcactccagcctggccgacagagtgagaccctgtctcaaacaaaagaaaaaaaaagaagaaaagaaaagaaagagagagagagaaggaaagaaggaggggagggagggaggaagggagggaacagccctgtttgaggaaaaagaaaacagccctgtttgtggcactggtcgaatcccatggtccaaatgccccaccatggatgcctttcagccagcagtgctgggctcgcaaatgaagagctgggaggagagcacagtgggagccgccagcccaggtcggaggccacactgcccagagccaatggctccttgactcccgagcagagggagggagaaaggccacccatatggcgggtttgctgttacttccgacttaacaagagacagaccacgtcttcaagccagggatgtggctagagtcagcgcggccttgtcacttgtgatgggtactgagaggtacagcctgggacatctagaacccaggaaagagaaaccttcttgccgtgtagggaaggtccccgcagggagaaggtgggaggatttgtattgtttccctcaccaaatagatgctttttggtggccgtcccagacagcgccggtgtgtgtagggatggccctgggtgtcctaggctcttggaggtctcctcttcctcctcactttatggggtgtggataacacctggctcacctgcccggggcaacagaatctggggtatggagttgagcgtgtggcagccgggtcacgggtaaaatcccttacgggggtcatctgacgtggcagctgctagaccagccgccacccaccacgcagcaggcctgctgagcccgggattctctttccagggatggcaccccaggcagccagagtgtggctgagaagttcgaggtgagctgggagacggtgatggtgagcagccacggcgcggtggtggtaaagtgtgacggccgtggcagcggcttccaagggaccaagctcctgcacgaagtgaggcggcggctgggcttgctggaggagaaggaccagatggaggccgtgcggtgagcacccgcccaggaagcaggagaggccgggaggggacggggctcctcatgggggcagcaccgcagtcacagtgcgggaatgctttttctccacgcacacatttttcatgcaatttgctcttacctaaaatctcttggccattccaaagaagtttcaaaggaaacttaggaatcttctcctagggacatttataactagttttcccactgcagggtagattgttgagttgactaaaacaaggggatagaaattgccggttgggttggcttggcttttctgcgctgtggtcactgacccgggccagtgtccacgcatgtctttgccatttatcccaaggggaggagagaagagatcaggaaggaaggacagaaaaagggaaggaatatgaatggggctggatccgtggaaatgggtcaccctcgttactgagagcaggacctccatgcacatccaggtggggccagaatgcccttcccggctctgaggaagggcaggcttttgttctgtcattcctgtgcatccctatcactgactcagcaagagcaaccgacatcacagaaacaaaaggaggcttagcaccaaggggcagatgctccaaatgacttattgaatcttattgttgcactggaaataaaaagacatcaagacactgcgccaggctgcagctggccttcaggctcattttgtagaagcagttttcacagtctgatggcacagaggactgcagcacttactctaacttcaccccttagagatgctgcaggaacagctcaacggactgtggacttgggttctgagaatgacaagaaggcagggagaagcgcatctaccagggacccccgccgcgaccatgatcatcaccgttatgggcaggggagcgtgaggctgggcccgggcacacaaggagggtggagcacagagcccagctcagtacatgtttattgactggacctggcatctctgtacctattataccagggtgctttgtgcgtttggaaatttttactcaactgactttgaaaacatttctcctcattttgaaaaagattgacggccctggtatgtactcagcgaatggtctttcaatggaaaacaatgagcgtgtgaatgaatggttccggtcctcctccagggagctatgagctgggtgatggcagacaaagcaattgcttcagaaacccgtgttgcagctgggaaatacggagcgggagagctctcaggactcagatactcagggaaggagtgtctgccaggatgcctttgcctggaagtcaatgactacaacaacacatgtgtgcgtgcacacacacacacacacacacacacacctctcaaataaggaactatattggctacaaaagacacagggatgtcaggtctcaaggttgatgaatccagacaccaacaatgtcaccaacgacccaggctctctccgtctctccgcccagccagccatgatggtctcatcctaagccgagccctcagtcacggggtggccctcagtagcacctggctccatgcttcgtcatctacctccagcaggttggggaggaaaccacttttagaaacttccagaaaggaaaggaaagtctccccacaagcagacagcaaacctctccttccatctccctggccctcccctgcccattccagaacctgccaccagtgagacaggtgcaggcagcccccccagagaccaagtgggtccgtctgacaccagtgtggggccagcccctgagcagaggatgtggggtgacaagggaatgctggggttcagtgtggaaggaggatgggtgggtggctgctgggtcagcagcgggcagtgccagccacagaggactcccaggacacggaagccggcccaggctgcgctctggagtggagtgggcctggcttcctgggtgggggcacgagtgctctcctggcttcccagacctcctcctttgggtctttttcatttgtgtgtggcttcccctgccatctcctgctctttcctcaccccacctgctctatctcctcccagggagatttggaagcccggggcctccccgccatcaagggcaggcccaggggaaagtcgcagcaccctcaggctccccttcgacacttggctctgcctggcatcttccccaaagagcacaggaattagagggcaaaggtgtttcacacacacacacgtcgtgccctaaaaagaaggaatgggcccaaccatctgttccaaaacaaggcagaacctgttctggaaaaagtcaataatgccaactcctaaaccaccgaagctcaaagaatgggagcgtgtggacaacggcaaagcttagagccgttgccaaagcacagactttcttaggaagctgatgcccaatggcgccaagccatagaaagcctccctcagctctccctaggaacgaggtctgcattttcattcatcagaaagaaatagcccaatttgatcggaaacctaaaatcaggaggctgacacattagcctgactcctcccactcccacagttcccccgtccaccaccaccatatcctcaccgaggagcccacaggccagcctcccacgagcagctgagatgagctgtggaagggagctcgtcccacccctgtggaaggcagcgggcagctgtgtaaacccgactagggccggtgggctcctgtctcctagagacaggttgtctctgggctcaacttgggattttcttcacgattgtttcttttgggtcctacgtgctcatgtgtacacacacagacaccctgggtcatgtgctaaggagcagcagaaatgcctcatttttatttactcatttgttcacgtagctagtggaggaagccaaaatagttatccccaaaatattgagacctgctaagtgaaagatactgaaaacacagggactctctgcctctgcccctgtttgccagacgccaggacatccatccttccttcctggggacagcacctgctcatcagcccagagagggtcccagccgttgccagggtctctgggggcagattgcattgccttctcacaggttccctccttttaaaagactgggggctgggcatggtggctcacgcctgtaatcccagcactttgggaggcccaggtgggcggatcaccggagtccaggagttcaatcaagaccagctggccaacatggtgaaaccccgtctctattaaaaacacaaaaatcggccgggcgcggtggctcacgcctgtaatcccagcactttgggaggccgaggcgggcggatcacgaggtcaggagatcgagaccatcctggctaacacggtgaaaccccgtctctactaaaaaaaaaaaaaaatacaaaaaattagccgggcgaggtggcgggcacctgtagtcccagctactcgggaggctgaggcaggagaatggcgtgaaccccagggggcggagcctgcagtgagccgagattgtgccactgcactccagcctgggcgacagcgagactccgtctcaaaaaaaaaaaaaaaaaaaaaacacaaaaatcagccaggtgtaatcccagctactcaggaggttgaggcaggaggatcgcttgaacctgggaggcagaggttgcggtgagccacgatcacgccactgcactccagcctgggcaatgagccaaactccatctcaaaaagaaaaccgtaaataaataaaagactggagctgctctctcctttgcctggtcactatgctgagagttatggctctttgttaaaatactgtgtaaacagggcccctacaccactgccttaagaggcactggaactgaggcctccgccacgtggagggcacagcgcacgccaggaaatctcttccggttttcctcttgttcatctgactttcattttcaggacagtgacagtgtctcgaccaggaactcataagggttgagaaaagaaattatattttctcctctttactagaaaatgtctaaaaatatctctaactccacacttgacattatggcttggcttgaggtaaaatccagacagacaataatttccatctaacaagcaacaagcccacagcctgcaggcgtcctgctgctggttgaggtccagaaaccggaaggaccccagccacttcgtgggggaagcagaagaccacaatgcggggcaaggtcccagcaagggtgaggcagggacccaggcagcactggcccagagcactgaggcccagagcaccaagcggctgctgccaaggctgggccgtagcaggaagctcatgggaagaatccctctgtggccaaacaggtacaagacaggggcctcctcccaggaattgggaacagaaggctgtgcaggtgggatggggtctcactggcttgactctgagcccagaagcatagaaccagagctccacagattcctgccgacccctaaggctcatcccagagcccgcgtgcttggagtcacaggctctgggtgggggcccaatagcagcagatggaccccatgcaacaggggctgcgtctcccagaaggggctctgcggctgtggattaatggctcgcagtcgagaagcttctatacctggaagtgctacagagttattgcaagggtgctttgaggttttaacgtgaacatgctgacttggcactaaataaataaaagcaataaataattatattggaatgctaaggttgctttttatttgaagaggggttttcatccttgaaatggatggaaaacatggctctgggctacaggaagacaaagtggcagcaggatgtgcactgaaccctctttcccctcctcgacctcacaggacgatgctgaaggagcagtacattgacaggacgcgcgtggccgtgtttgggaaggtgagtctgcgccaccctggtctgaaaacccctcagttccagtgtggcctgcaccattacccacgtctaatcctgatttattgagaacgtctgtggtctgctggtgagcaagtaattttttaaaatcaagagcctgggtgcttagtgattccagccgtgggaggtttcatttgatcagctcattttcctaagtttctttttacattatctggaaggaaagagaagggaagccaagtccccgcaggagagctctaatacattcctaatgacttttctcccatccatctgctgtagctcttggcatggtagccaggaaagaagcaaagcaggaatctatttctggataactcgatgtggagtaacaacgttaattaccatgtctacttagacggaagcacaggtgtggggagggtcgcgcagtgaactctcaaaccagagccgctcccatctggtggcccttgtcagaaggctgtagcctgggacagctcagctgtagctgaggcccacggtttggagttaggtctctgcaccgccacctactatggccctggtacatggcccctcattctccttagcctagacctggggcctcttgatctcaagaaggccagcacacagatgggtcggtatagacccatcttccctctgggagtgaccctcagcacaggccctgcagaggaggccttgctgtgacacccccgcaggtgaaggcttggacaagtaatcagcacagtgcctcttacgtcatcgcctccaaaacctcagagcccagcatgcactggagacccggccctgccctgtgggctgctcccggaagcaggggatgcaggagccctcccacacctcctccttacctgccggaggtgaagtggtcaggaggagggccggcggcttctctccttgttcagagcccgggcacagagccctagaggtgcattccaggtgcctagatgtccactcactgcctgtgaggcccgaagccactgggtcattggtaggtgtaacttgggtgtcaatagccatcacctctccccaccctcatggaagtgacttcccagcagactggcagctgaaaggcagggagcctgggccgtggtcagtcttttccagtcgtcactctgccccaaatgcacatggatgccactcctgagggcttggcctccttcctgtgccttgcatatagtccatccactcagggcctttcatagttcacttctggacacagagaggctttctcaacaggcagttggtccagaagcacaggcagccgaggtgccaaagggaaaggggaccctgtgcacctgtcagagcacaactgatgcacccccacaccctgtacccccgcactcagctccgccgaggacatctgtctgagctccgtgctggggatctttcctttgccattctgcccagtggatcccgggcgtctttccagagcataagcatctctgttttgttttaacaagccttagatagaggtccgtagaccccacaatggtatttctcctctgaagaataaagcgtcaatccttttagtggcttggcatgttgcggcctgtccattctgtttcctcctcgcatgtgccccagtgatctggctgcagcctttgtcaggcatcgcaggacctgggacacagagcccaggggagcagcagccaccctgcacccagaggtgacctggagagcaagggggcacctgtgcgttatgttctgcagtttcccccccgacaccgaaaatcccccctgcagaagattgcctgtctctcatttaaaccagagcaggccgcgtggccctgcaggaaaatgagatttaaagaaaacgaagaatgacaagtaaggacgtgtggagttcactgacaataaatattatttgtcagaaaatgaaaatcttctttcattgtcattagacaaggtgcccctgccctattaaaggaacacaccggaacgatcgtgcaggtcataaatggttgatcttggagtttggcatgacctgcgcttcacggtctcagtcaggtacctgggttctctacactccatgctcccaacacgcatgctcacagactcacatacacatggatgctcacccatacacatgctcacacacacatgctcacacattcacacacatgctcacccatacacctgctcacccatacacatgctctcacatacatgtgctcacacatacacacacatgctcacccatacacatgctcacacattcacacacatacacaaatgctcacatacacgctcacacatacacacacatgctcacccacacaatgctcacacattcacacacgctcacccatacacctgctctcacacacatgctcacacatacacacacatgctcacccatacacctgctcacacatacacatggtgtcacacacacgctcatacacacacatgctcacacacacgattacatacacctgctcacacacacacacatgctcacccatacacatgctcacacacacgctcacattcacacacatgctcacccatacacttgttcacacatacacatgctctcacacatgctcagacacatgctcacccatacacatgctcacacacgctcacacattcacacacacctgctcacacatacacatacatgctcacccatacacctgctcacacacacatgctcacccataaacatgctcacacacacacatgctcatacacgtttacccatacacatgctcacacgattacatacacctgctcacacacacacgtgctcacaaattacatacacatgctcacacatacatgctcacaaacacgactacatacacctactcacacacacatgctcacacaattacatacaccgactcacgcacacatgctcacacaattacatacacctgctcacccatacacacatgctcacatgattacacatgctcccacatacatacatgctcacacacattacatacacatgctcacacacgctcacacatacacacgagtacatacacgctgacacatgctcacacacacgattacatacacatgctcacacatacacatgctcacccacacacacgctcacacatacactcacacacacctgctcacacatacccatacatgctcacccatacacatgctcacacacacatgctcacccatacacatgctcacacacatgctcacccatacacatgctcacacacacatgctcatacacgtttacccatacacatgctcacacacgattacatacacctcccacatacacgattacatgcacctgctcacacacacacatgctcacaaattacatacacatgctcacacatacacatacatgctcacaaacatgattacatacacctactcacacacacatgctcacacaattacatacgcctactcacacacacatgctcacacaaattacatacacctgctcatacacacacacatgctcacacgattacatacacatgctcccacatgctcacctatacacatgctcacatacacacgagtacatacacatgctgacacatgctcacacacacgattacatacacatgctcacacacattcacattcacatgttcacgcacacatgctcacatgctcacccatacatacacacgattacatacacatgctcatacatacacgattacatacacatgctcacacaggctcatacacatgctcttacccatacatgctcacacacacacatgctcacacacaagcacacatgatcacacaggcacacatgatcacacatacacaggcttgcacaagtttacacacatactcatacatgctcacacaggcatacacacatgctcacatatgcacacactctcacatgtataggcacacacaggattacacatgctcacacatgtgcttatacacatacacccatgcacatgttcacacgtttatacacacatatcacacacacacacccccatatactcacacacacgctgccacatgctctgtctctcacacatacctgacagttccgtgctgtcccgtttccctcggggtcttcccttcggaggctgcagctcgtctgagcatccagccttgaaggcactgagcaggcaaggaggtagggcttttctctggggaggcctgcgttgcagtacggcttcctcatccccaccaagggcagggaagggcaggagtctaggacttacctgaatacagaacacctgggagcgtctgtctcgtgtcggccttgtgctgagcatgtgcagaccaggacttgcgccctaagccacttgttggcccctccctcagaatcatgtgcagtggcttggcctcacccacagacaagggaggcggtaagaaatgccataaagagacgctgagcctgaaggacagcaccttacacctgtgcagtccacacttgcctttccaattcgccgttgcatttcatcctcacgtcccttgacaccaaggcccagaagcggagaaggcgcacgtcgcataatgctgagttggaagggagtttgcttttcatctcttgttactgccccgtgaacaactttccaagtgacacattttgtaaaaggagagaacctgcatggaactggctgctctggggctgtctccctgcccgaggctgcttcatgctgagttactgccaggactcctaactgtcttctctctgcgctttctccaggattacggtggctacctgagcacctacatcctcccagcaaagggagaaaatcaaggccagacattcacctgcggctctgctctctctccaataacagacttcaaactctatggtaaatagccctgcaggaccaagcgacgggctctgctcccgccccgccccgccccctgcctgcgtggccccacagccctcccttcagcaccaccgtcccgctaaccacaggtgcctccaggccacagtcaccaccttgggctgatggaagaacccggggaaggagagggaagggtctcaggtaatatgttttgaatgaaagtggtcaatccccagatgcctacaaatcacatcccaatgaagaccacgagttggaaacagctagtactccgctggcagcagtgggggcgaggaagccagggtgcgcaggaggggagcaggtgccacaggccctgccgggccgccctccttctctgctcccagaagaatccgagcagggccctgccctgagttctatgcctgggcatgggtatttggtgcacaggtgttaccagataaggaagggatggttgggagggaattgctaccatagagcaattcaacgaggtccacgtggctcagctctgccttcccatctccctggccatgcaaatggcacctggtcagcacctgtcctcagagagtatggctctccatgagcacaaggcagagatggggtcaggctgtcagggtgacctgctgtggggatcagatggagatgagcccacccaggtgtgggaaccagacctctgtccaggcacagaagggctttgctgtgtttgggggttccaggctcctgcattctcctccttatggtcacccaaccctttttctctgaacctgagctctgtgacctgaacccatttcttagaatatacagagaggtcttttctgtggctccgagaacttgaattcaggtcagggctccgtggcagccaggctgttccctccagctgtccccaccctaagcagcgctggcaagtgaggtggaaatggagggggcttcctgctgctggtccaccgcagtcctgccagagcctgacattccctgcaggttggaggaacgagtccagcccccattgccacacctagccctagccctgctgtgctggccgagccctgtagacaccgcccagcaaggcagggaccacggtgggcccagcagcctcctggctggtgcagccaagtctcccaacaccttcacagcgggctcactccagtgcaaattttaactcgtacaggaactctcctggtccaaaatgtgaatcatgtaagaggaatcttccctcaggaatgcgggtgccaccttcaaattgagtgagactttcttaattctttcatcatgctgtttcagatttgtctgattcaaatgcacataaatctgaatcagattgtctgattcaaatgcacacaaaagctgccatcatgtcttgatgggtcactgtgcccaaaaccagccagtcctcttcattgtctcctgggcgccctcaggcttaccctgcaggccaggggcactgtgcagagccctttcggccctcagccctgggagaagcccctgacactcttctgtcacccagctgaccgcagggcctcaggcagaaccaagagcagggatgtgcctggactttttaaaaaataagtaaatcttgatggaaatgtgctctcttaccacccatgcccttcctaagtgttgaaggaggaggttatcctacttatttaggaatcagattaactgggttttgcttaattaaggttctgcgatgctgatgaaaattgcaacaccggcactcacacacattaaggttcccgttgtaccgcctgatgccccttgtaaagacccaaatgatttaggtggtgtttttaaaaaaccaacaatctgccacacaagtggcaagtgggaatgagcctgagtcctcaccccgcacccggtccagggccctccctagagtttgggggctgcgctcacagggcctcgaagccagaggtaacctccctccctttgcttccgtgcagcctctgcgttttccgagaggtacttgggcctccatggacttgacaacagagcatacgaggtgtgtatgggcacaactagagaatgtgatgagaccagtcagcctctgccacagtctcccagcctgccctggctgtatggcccactctgccttccccagccccatgcttctccctcaccagcaccaaagcccactcagaaacctccgaaggatcattccaccagagagtggattgaggttaacatggcctctctgggttccgcctgatttcccattataggacttgagggatgaggaagaaagtaagaggatatttgatggcggagtcagtcccagcgtccatggatacctgatgtgcacaggactcctggctctccctacagccagagctgtgctgctgggggagagtgagctttttttttttttttttttgagatggagtcttgctccattgcccagtctagagtgtagcagcatgatctcggctcactgcaacctctgcctcccaggttcaagcaattctcctgtctcagcctcccaagtagcttggattacaggcacacgctgccacgcccagctaatttttgtattttcagtagagacggggtttcaccgtgttggtcaggctggtctccaacccctgacctcaggtgatccacctgcctcagcctcccaaagtgctgggattacaggtatgagccaccacccctggtccgagagtgagctcttgactgaggagcagaaggcctctctgatgcgacctcctgagtcagacctgttgatttggtgcagctgtcagacacggcatttctccagctgtgcgcagggagggaggccagagctcctggccgaggcagcactgcattttcagagtggaaacttggacaaaggaactgagtccaaccagggagtcagctccctgaggctccaggtgaaatgatggccctctaaggctacctggagttggaggaaactcttcctttttcccttcttctcttccaccccctcctcttccaaaaagggagttaatgtgggggaaagctgggtgtggtatattagtccgttttcatgctgctgataaagacatacctgagactgggcaatttacaaaggaaataggtttagtggagaacttacagttccacatggctggggaagcctcacaatcatgctgaaggcaaggaggagctggtcacatcttacacagatggcagcaggcaaagagaaagcatgtgcagggaaactctgccttataaagtcatcagctctcgtgagatttattcattatcatgagaacagcagcacaggaaagacccacccccatgattcattcatctcccactgggtccctcccacaactcgtgggaattatgggagctacaagatgagatttgggtggggacacagagtcaaaccataccactgggcttctgacatctgccctgcatttctttgcagatataaggcatcccggttctccgggaacttagtgttttcaatacacttcacctaccttctcagtcaggtttccaagcagaacacctggctccctgcagtgcagccccctaactctgtccccttgcccccgcatgtgcagatgaccaaggtagcccatcgagtctccgcgctggaagaacagcagttcctgatcattcatcccactgccgatggtaaggactgaaaacatgaattcactgtgtatctagtaagagcctcctccttgatggcaccatgggttttaacaaatgtcttcctctcttttttttttttttttttgcacagaaaaaattcatttccagcacacagcagaactcattacacaactaattaggggaaaggctaattacagcttacaggtacagtacgcatgttactctgttttgaacctggagcaagacattcctttcatggagaaagacctgacgggtgttcagggccttctactgcagcagacacgcctgtgctgtggtggtcggtgatgagcaaggtcccagcaggttggaaaatcagcacatgctcaacgttttcttataattaatgatagctccgctctgtacttcagcccggtttaaatccctttaggacaaccatctccccgtactcccaccccagccctgctcccctcctccgggcagtgagaagaaccaagccagcacccaccctgcccagcagtgtggctggggctatcccgctgcggagagtgggactgttgttctgggttggtgagagtggtgctggtgggccctgagccttgccccactgcttccctctgaccaacaccacatgttactacgcactagcaggatgtcctggggccatctgtagctaggcagtagtgaaagaggggtacccttcccagaactgaactcactttcccacaaccaacccgtggcccgtccacaacagcatcaagtgctgacccagcagcctcaaacctgggctcttcccagtaatgcacagggatgtctctggaaacttctgccatttccttcctgccttctgctcctttggtggaacaggtatgacccaatggtctcttcaggtccaacatgaatgaatgggagagctccttggggacagatgacaggcaggcaccctgcctccctcagagagctcttgccctgggctgatcactgccttggcctccagcatccctgcctgtgggagggagggaccacctgtgggcttgatcaggcagggagagctccagccagaagggagttggaccccagtgtggatgaagaggggcagaaggacggggttacaccacacttgagttcccttgtgaaagacgttcagatttcagactttttcaaagtaagtgtggcagttgcatggcagtgttaagcacactgaccatggacgctccaaaggtccatgtgtatgtgttcatgtgggcaactccccaagatatggggcgagctgaaccccccaggtacagagcagcctgcatcgctgcaggctccatgggtatcagggagcaggacccacccagggacacacatgtgggcacagcaaaggccttcacagacaccccatgcatctggagccaggcccagccccaggtaagagcacgggagacgggggcctgaggcaggaggagaaagcttcctgcccatatcctcttgtactacttgatgttttaatgacatatcatagcctaatgacagcattaataaatacttcaaaataaagatgaatttcaccctccaaaaacatacaaagaaggcaggaagaggcagtctagtgtcatagaaagatgtaggttttgggccagatgcagtggctcacacctgtagtccctgcactttgggaggctgaggtgcggggattgccttgagctcaggagtttgagaccagcctaggcaacagagcaagaccccatctctacaaaaagtttttagaaaatagccggacgtagtcatgtgtacctgtggtcccagctacacaggaggctgaagtgggagaatcacttgagcccaggaggttgaggctgcagtgagctatggtaacaccatggcattccagcctgggcgacagagtgagaccctgtctgaaaaagaaaagaaaaaaataagatgcaggctttgaatccctgcacgtgcacagatggttcacggtgctcctaggagatggtggcatcaccgcattggcagtagaataattagccatcatcctattggcatctgggaccgaatgagcccacattccaggcctcattctaagcacggcacggctataagattgtttaattctcacaaagtgtcatgagctggagtctgtgattatcctccccacccgacacacctggaatccgaggctcaggcaagttaacctccacagtcacacagggagtagccaggacgcaaaatctgtggggtgggcccgtgggcacccaggacagcacgcagcccttccacgggagtttcccacactcagagtgtaactgagagagcataggagtgtaatggcgcgatctcggctcacagcaacctccgcctcctgggttcaagtgattctcctacctcagcctcccgagtagctgggattacaggcacgccccaccatgcccagctaatttttgtatttttagtagagacacggttttaccgtgttggccaggctggtctcgaactcctgacctcaagtgatcctcccgcctcggcctgccaaagcactgggattacaggcatgaaattctatttcttttcagagcctgacaccctgaaaacttgggctgcggctctgtagtccctaagcttgtatccatgttgcaaattcaagcaagcagatccggactgtagagtgttgaatgaagagcttcccaatgttttcacccagttcccactgagcatttgctgtgcctggagagggccaggcaccgggggcgtggtggtgtttgaaggctggttggcttcacgaatgggtggtgcatgtccacgctaggggaggcgcccctctgactgggacagccaggcagatctcccaggaggaagaggcacttccatcaggagtggcatggttagcaaacccacttcatcaactacaatccagccccggacggggcccaggtttcactaaactccacaccttctgtgcgttcccgtcccctggggagcgtatacctgggagagtaatttctccgtgccttccttgcagatttacccggacgaaagccattactttaccagctccagcctcaaacagcatctgtaccggtccatcatcaacttcttcgtggaatgcttcaggatccaggacaaactgctgacagtcacagcgaaagaggacgaggaggaggactaagctcaggtcgctctaagcacaaacgtggctctttctacaaccagatgcaaccgagggatttccctgccctccctcttccctcggaggggcggggcggggcggggccgggtgttccatagcatgtgtgtctcggatgcggaaggcagttttgcttgggaaacaagctccttccccggggtcatcactcacggcctccatggcaccagggacaacgctgtccccgcagcagcgcctcctcccggcgcccgagagaccggcacgccacggcccctcccccaaggaacagagcaaaggatggtggccgcaggccccacgcgagcccacaggacaccggcccctagattccagccaccaagcggaagcatgagacccgcccacactagcctctgtgttcccgttagggacatcacaccctgtctcacgtcgcagtgccatggacgcagcagttacagcaccattgttttagcagtgcgtgttcatatatgggcttgctacttcctgtaatgaggacgttcaacatggtgaggggctacaagaaaacgcttttctgtacagagtcttactgtagctacgctaatggttaacctgatagaattaactcgtatttttctatggttttaacctgatgctccactgtctccgtcatggggttgttttgctgtttggggttgggccttgtttccctttcctttctccagtccacgtgtagactttgcgcttgatgaagaagcagatcggaagtaactgctccctcctcaaggttgtcttcagacgtcttggggacgttcctaaacactgagggggaagacagccaatagcacccattaaaagaaatacctaaataaaacctctctcccactcagctatgctagggcttggctgtaggtgtgcactgtctatttacatccgtccttacaaccatccttgtcctccttggtaccgtatcaagctctttcccatgacatttggtttaaaaaaaaaaaaaaaaaaaaaaaaaaaacagaaaaaagacaaagcgtcaactccacccacaggcccgctgtgtgtgctcgggccacgggagtcctgagggttctgtgggcctgcgcgcatccctctcccatcgtgggggtggctccgtgaccttcctgccacgagcaggaggttgatgatgtgctacgttagccttgtaagatacacccccaccaaatgtgcagccggtgttcccagtgtatatttcattctcttgtatataaaggaagcaatgtgtgtcaggcctctgtgcagtcaacccagcctcctcccgccagtgctaaccccgtgttgagcctgcatgctgacactgtggccgatctggactctagaagtgctagtttgaaatatatccattactgtcatttccttttgagcttgtggacaagctgaatgtcaggactgacttcgccagctcccagccctgcgggggtgtccttggcatcccatcagcagaggagatgcgtccctgttgcattttggcgtttggggctttgggtttatccacatgagctctgaacgtccgttatagttagggtgattggaaggtctccatcactgggtgttttaaaggtgattcaccaccatttgtgaaaggaccaacgtgctgataaacaggaccgatccgagtgctacatgactgtgcgtttgctatttcaatgggcctgaacgactacaaagccagctaggtctggaaggggaagccagctctggccacgacatctggtcggagggaagtggggatgtggcatggtagcgtctgttcatccatggaataaaacattattttacca

SEQ ID NO: 407 - DNA, 936220 bp, Homo sapiens
  misc_feature (520860)..(620859): n is a, c, g, or t
tgctgctgctgctgctgcctccccaccgcctttttttttttttaatctggagcggggtggggagtgggaaccggagagaaagcaaaatattaaaaagccccaaagacagccagcaggagcgcggtgcccgatggcttcgctgtaccagaggttcactggcaagatcaacacctcgaggtccttccccgcgcccccggaggcgagtcacctcctgggcggccaggggcccgaggaggacggcggcgcaggagccaagcccctcggcccgcgggcgcaggcggcggcgccccgggagcgcggcggcggcggcggcggcgcgggtggccggccccggttccagtaccaggcgcggagcgatggtgacgaggaggacgtaagagcttctcgggggcggggggcggcggcgggttctccgggctgagcgcgcagcgagacgcgtcggcaggggaaattttttttggggggggaatcaggcgccctccccccgcccacgactctccgggcgcccccagacaggctccgtggcgccagatcgcggtcaccgcgtcccggagggagcgggtctgtgtctgcagccgcggcggccgggagttggtggctggagagagcggggtttgggtactgcgcctgctgggatctggaattcgccttacgttccctgggtgcgcggatgtctgtttttaacagcatgctgctatggttcctaaggagagaattcgatcggcctgtgcttacgagttggtttattttttatttatttcgtgctccgggaacacagcctcaggcaccttctctccctcccacctgtgtctggaatctctccatcgtgcccctcctctcctactcactctgtcccttgactcaaatgcctctccttcgttcctcttcttacttctcctagacactttttccccccagcggtggtgatggtgattatcctttccggaaaaaaaaaataccaaaatactggcatctgagccccaaccctctgtcccagggcccagctcttttgctgagagccctcaggccgtgtctgtctcccctcccagccctggactagcacctctgccttagaccgtgttcagtgaaaacttctccgagagcacatttcctactcttcatgggggctggaagcctgggtttcaaaggttggatttgcacatcgccctagtaaccaatgactcatgcaggacaggagccggaccttagatggatgcgtttaaccacctcctgtggatccctttcaaggatgcagagggctgctaggacttagaagggaggaaactgtgctttttctttgaggccttcttttcccagggaaaagagaaaaatccccgacaggctctcagagaaacaggtctggcttggctggtacagctcttataacagctaggctgtgttggtttgtagaaattactatgtatgcctttgaggagtttcacaactgctcaacctgggaaccgcaggggtcccaccggcctctcacttagtctaccctgacatacccagggcagtacattgccgggcactgagtaggtggttttggtcattacctctctgcagcctccagccacgctggttccctgtttcgtatttctttagtgcaagagttgtgtttgggtcgagggaggggtgagacattgagtgatttcccagggacaattcctaattgccagatactatgaaatcagtgaggttttgctgttgttattggtagtttttgttttatgaatgaaggatgtggaaactttaatggagatcacaaaactttgtgggagatgtggtttgcacacacacaggtacacaccccctacagccctgcgtcagattttgcatgaggttttgtgattttctcctgcatcgtttccagactcccctggttaaatagtcattcaaaggcatgtccctcactttggtgggccaagccctgagggaaatagacagatccttcagtcatctggttcaagtctttggcaaatggtttaattgggggagggtgaagagttctggaggattaaactaccgagaatcttggggaagacagttaagctgcaatgcaaacaggaaaaatgtactttttaccttaaatctgacttaaaattgttgaattgtggatgtttggaatgagaacaatgtgcagtttttttctcaacaggctctaggtgtcgctaggagaaaggaaaggcaagagctctgaattttatttcagatgatctccatctttttttaaaaaaatcttaacttggagtatacatgtccttctttttattgtgacatgtgtctagaaatgattctcagataaacacaggtgtcctgagaaacaaatcagggatataacatgtacatttgttaatggggttctaaacagcatctctaacttagatgtaagtcctgacatgctttttttttttttttctggaaaatacacaatgtgtgtgggtgggcgtgtattgtgtgtttatatagtgtactcccgatatatatatgcacacatatatacttgcccattatctgcacatatatatctggcacacatctgcaaaatgcattgcacatatgtcctttaaattgtataattaaactcatgacacaggctgaatgttgcatcctttaaaaacaacaacaaacttttatgcactcttcttagaaaagttcctcagaataggaaaagttatgcccccaaatttactaaaagatagatgaacatatcaaaccacttttcctccaggaacaaaagcttcaatttgcttaaagtgtattgaaaaacaaaaacaaaaaaagagattaggtagaaaaactgctttttaggtacagatacttgccaaggcaaggctgaagaatctagagtaatcattttgctacccaaatttaaagctgaggatatgcaatgaattaggaacacattgcattttattacgtgtcttgcaactgctgacaacctcaagacaaaccgaggctttccttttccacatctgcaagcagctgggagcgccgctacttcggtgggagctgtctgaggtgctgaaaccttctcttggcttagcgcaggagaaatctccatcactcttgccttttcagtcctgatcccaaggctggtggctttatcgctgttctctggcttgtcagggaagactgttccaaggtacagaaacagcttcgctgccttggtcactaagatgatggcaagcagcatacctttataatccttaggactttgtacctgttgtccttctgtctggaaattgagaaatatagttcttggcttctgtgcatgtgtgtacacctacatgcctgagcatgactgagaatgggcaattacccagccacaacccaaataaaatttatggtagtctaacaaggctaacacagagaaataaaatgcggagatagaatggctagaattaataatgcatggtctaaatgcacaaactacacaggcaacaaagggacttcccaactgtgtggctccacaggaaagcctgttttgggtgggtcagtactaacatgcaaagtctgacttcaaaatagaaataaaaccagagggtcttctctatccacttccttgtaaatcttagatttatttaaatataaagtcaattacttgggcaactcctctgaggaatcaatagcccttctgatttaaaattcattgtgtaggtttaaaaataagttgactcttaaaggaattgttgctggaagtgacttttagtggaatgtattaactttcatttggattaactgtggctaattttaaaatactgaactttgtcatccgcctgcttgaacatttctttttagttttttaaagggctttggaggccttctgtaccattagagcagtagtttttttaaggttatacagtgtgttcctgtatccttcattttcagtgacacgtggcttcttagcaatacaaatgtgatgacaacaggattttaaagcagcaaattggttaaaactgggatagatgggcaaatcaccacccatgatgtccaccagccttggaagggccaatttcatcatccgctatgtcttcggcaaccaacccatttttttcctccaccttggtttttcattggtataatgtcaacattctgttaatgtgtccttgggatctatcaactttacgatttcttaactagcttccctctacaaatatgtttttatactctattacttttcttctgtttcaactgtaatttaaaattttttaagtttcacatgattttcctgataaatgagaaaaagtctaaatctttcaactgtctatttgatcccattactctcatcaccaataggaccagtgcttggtgtactcacctacagaatagctatggatattgcaggagcatggagagttgcaatgttgccctctcttgatcccagtggcccctacaaagtgggagccatgaggccaggtactgagaagtgcccagtgaatacatgctgctgctgttactaataatattactgtttctaaaggatggccaccctgtttgagggccttggcagcaactgcccagctagtacaagaagcaaaaaagctgactcttgggcaaaacctgaacataaaggcctcccatttcgtggtggttgagagccagcccctcttccccctctggctcttgtgacccccatcacagggtggggagacaccccccgcgaggcggggactgagagccagcccctcttcccccactggcttaggacgcccatcggggatcctaagatccttaggacccacctggaggactgtgggtatgaggtgttcaagaagaaagctcaaatcttccgacggcaggtaccttgcgtgggatttacaatacgacaggggtccgaacgcagctcaggaacagaaagaaagcaggttatttgcaatctaccggagcttaagggcagaaggcaggtgagagaattcttaggagctgtggggttttgtaggctgtggatcccaaacgttgcagtattagccaagcctttgtatgaggtcacaaagggggcggggacccggaacctttgaaatggggatcccgacaacagcaagtctttcattagttataagaaaatcttctggcagccccagccctggggctacccgatctgacaaagccttttccattgtatgcgtcagagagagaaaagatggcagctggacttttaacccaaactgtggggccctggctgaggccggtagcctacgtctctaaacaactagacagggttgctaaagaatggcccccctatttgagggccttggcagcaactgccctgctagtacaagaagcaaataagctgattcttgggcaaaacctgaacataaaggccccccattttgtgatggctgagatccatcccctcttcccccctgactcttgggactcccattgcgggtggagggaggcatcccccatgaggcggggactcagagccaacccctcttcccccccctggctcttgggaccaccatcgcagggggggaggcaatccccgcgaggcggggactgcgaacctccccctttcctcccctggctctttgcacccccatcgcagggggggaggcacccctcgtgatgcggggactgagagcgagcccctcttcccccctttgctcttaggatccccatcgctgggggcggaggcaccccccgcgaggcagggactgagagccagtccctcttccccccctggctctgaggacccccatcgcaggagggggaggcaaccccgcgagggtggggactgagagctatcctctcttccgcacctggctgttggtacccccatcgtagggggggggaggcaccctccgcgaggcagggactgagagccaacccctggttcccccactggctcttaggacccccatcgcagaggggggacgcaccccccgcgaggcggggactgagagccagaccctcttccccccccagcttaggacccacatcgttgatcctaagatccttaggacccacctggaggactgcgggtggtaggtgtccaagtagaaagttcaaatcttccgacggcaggtaccttacgtgggattactgagagccagtccctcttcccccccggctctgaggaaccccatcacaggagggggaggcaccccccacgacagtggggactgagagctatcccctcttccgcccctggctgttagtacccccatcgcaggtggggaggcaccccctacgagagtggggactgagagctatcccctcttccgcccctggctgttagtacccccatcgcagggtgggggaggcacccccccgcgaggcagggactgagagccagcctctgttcccccactggctcttaggacccccatcgcagaggggggagggaccccccacgaggcggggactgagagccagtccctcttccccctctggctcttaggaaccccatcgcaggagggtgtggcaccccccacgagggtggggactgagagctatcccctcttccgcccctggctgttaatacccccatcgcagggtgggggaggcaccccccgcgaggtagggactgagagcctgcccctgttcccccactggctcttaggacacccatcgcagaggggggaggcaccccccttgaggcggggactgagagccagaccctcttccccccctggcttagggcccccatcgttgatcctaagatccttaggacccacctggaggactgtgggtattaggtgtccaagtagaaagatcaaatcttccgacggcaggtaccttacatgggatttacgatccgacgggtccgaacgcagctcgggaacagaaagaaagcaggttatttgcaatctaccggagcttaagggcagaaggcaggtgagagaattcttaggagctgtggggttttgtagactgtggatcccaaactgcagtatgagcaaagcctttgtatgaggtcacaaagggggcggggacccggaacttttgaaatggggatcccaacaacagcaagtttttcatgagttacaagaaaatcttctgacagccccagccctggggctacccgatctgacaaagccttttccattgtatgcgtcagagagagaaaagatggcagctggacttttaacccaaactgtggggccctggctgaggcccgtagcctacgtctctaaacaactagacagggttgctaaaggatggcccccctatttgacggccttggcagcaactgccctgctagtacaagaagcaaataagctcattcttgggcaaaacctgaacataaagggcccccattttgtgatggctgagatccatcccctcttcccccctggctgttgggacccgcatcgcgggaggggaggcaccccccgcgaggcggggactcagagccaacccctcttccccccctggctcttgggaccaccatcgcagggggggaggcaatcctcccgaggcgggactgcaaacctccacctttcctcccctggctctttgcacccccatcgcagggggggaggcacccctcacgacacggggactgagagcgagcccctcttcccccctttgctcttaggatccccatcgctgggggcggaggcaccccccgcgaggcagggactgagaggcaatccctcttccccccctggctcttaggacccccatcgcaggagggggaggcaccccccgcgaggcagggactgagagccagcccctggttcccccactggctcttaggacccccatcgcagaggggggaggcaccccccgcgaggcggggactgcgagccagaccctcttccccctctggcttaggacctccatcgttgatcctaagatccttaggacccacctggaggactgcgggtgttaggtgtccaagtagaaagttcaaatcttccgacggcaggtaccttacgtgggattactgagagccagtccctcttcccccccctggctctgaggacccccatcgcaggagggggaggcaccccccacgagagtggcgactgagagctatcccctcttccgcccctggctgttagtacccccatcgcagggggggaggcaccccccgcgaggcagggactgagagccagtccctcttccccccctggctcttaggacgcccatcacaggagggggacgcaccccccatgaggcagggactgagagccagcccctgttcccccactggctcttaggacccacatcacagagtggggaggcaccccccacgaggcggggactgagagccagaccctcttcccccactggcataggacccccatcgttgatgttaagatccttaggacccacctggaggactgtgggtattaggtgtccaagtagagagttcaaatcttctgacggcaggtaccttatgtgggatttacgatccgacgggtccgaacgcagctcgggaacagaaagaaagcaggttatttgcaatctaccggaaattaagggcagaaggcaggtgagagaattcttaggagctgtggggttttgtagactgtggatcccaaactgcagtattagccaagcctttgtatgaggtcacaaagggggcggggacccggaacttttgaaatggggatcccaacaacagcaagtttttcatgagttacaagaaaatcttctggcagccccagccctggggctacccgatctgacaaagccttttccattgtatgcgtcagagagagaaaagatggcagctggacttttaacccaaactgtggggccctggctgaggccggtagcctacatctctaaacaactagacagggttgctaaaggatggcccccctattagagggccttggcagcaactgccctgctagtacaagaagcaaataagctgattcttgggcaaaacctgaacataaaggccccccattttgtgatggctgagatccatcccctcttcccccctggctcttgggactcccatcacaggggggggaggcacccgctgcgaggcggggactcagagccaacccctcttccccccctggctcttgggaccaccatcgcagggggggaggcaatccccgcgaggcggggactgcgaacctccccctttcctcccctggctctttgcacccccatcgcagggagggaggcacccctcgcgacgcggggactgagagcgagcccctcttcccccctttgctcttaggatccccatcgctgggggcggaggcaccccccgcgaggcagggactgagaggcaatccctcttccccccctggctctgaggacccccatcgcaggagggggaggcaaccctgcgagggtggggactgagagctatcccctcttccgcccctggctgttggtacccccatcgcagggggggggaggcaccccccgcgaggcagggactgacagccagcccctggttcccccactggctcttaggacccccatcgcagaggggggacgcaccccccgcgaggcggggactgagagccagaccctcatcccccaccggcttaggacccacatcgttgatcctaagatccttaggacccacctggaggactgcgggtgttaggtgtccaagtagaaagttcaaatcttctgacggcaggtaccttacgtgggattactgagagccagtccctcttcccccccggctctgaggacccccatcgcaggagggggaggcaccccccgcgagggtggggactgagagctatcccctcttccgcccctggcttttggtacccccatcgcaggggggggaggcaccctccgctaggcagggactgagagccaacccctggttcccccactggctcttaggacccccatcgcaggagggggaggcaccccccgcgagggtggggactgagagctatcccctcttccgcccctggcttttggtacccccatcgcaggggggggaggcaccctccgctaggcagggactgagagccaacccctggttcccccactggctcttaggacccccatcgcaggagggggaggcaccccccgcgagggtggggactgagagctatcctctcttccgcacctggctgttggtacccccatcgtagggggggggaggcaccctccgcgaggcagggactgagagccaacccctggttcccccactggctcttaggacccccatcgcagaggggggaggcaccccccgcgaggcggggactgcgagccagaccctcttcctcccccagcttaggacccccatcgttgatcctaagatccttaggacccacctggaggactgtgggtgttagttgtccaggtagaaatttcaaatcttccgacggcaggtaccttacgtggaattactgagagccagtccctcttccccccctggctctgaggaaccccatcacaggagggggaggcaccccccacgagagtggggactgagagctatcccctcttccgcccctggctgttagtacccccatcgcagggggggaggcaccccccacgagagtggggactgagagctatccccttttccgcccctggctgttagtacccccatcgcagggttggggaggcacccccccgcgaggcagggactgagagccagcccctattcccccactggctcttaggacccccatcgcagaggggggagggaccccccatgaggcggggactgagagccagtccctcttctccctctggctcttaggaaccccattgcaggagggtgtggcaccccccacgagggtggggactgagagctatcccctcttccgcccctggctgttggtacccccatcgcaagggggggaggcacctcccgcgaggcagggactgagagccattccctcttccccccctggctcttaagacccccatcgcaggagggggaggcaccccccgcgagggtggggactgagagctatcccctcttccgcctctggctgatagtacccccatcgcagtgagggaggcaccccccacgaggcagggactgagagccactccctcttccccctctggcgcttaggacccccatcccagcggggggaggcacctcccgtgaggtggggactgagagccagcccctcttcccccccggcttaggacccccgtcgtggatcctcagatccttaggacccacctggaggactgtggatattaggtgtcctagaagaaagttcaaatcttccgacggcaagtgcatgatagtctgcatgaaaccctaataaaaaagacagtgaaggagaatcatgtcaggagctgatactcctgagtctcgggaagcctccagggacagagcacagctagagcatccaagaatgagaagagccctagagcaaacgcaaagcccaggaagagataattggtttgagaagaaaagggtccaggagttattgcaacccagctagcaagcagagtcctgggctgatcagagtggggaaaagccactgagttgttcaatggtaggacaaacagagccctgctgcagggaggggacactcatctaccctgtacccccatacacctctgtcccgctccccgttcaggctgacaatgtgctcaccacacagcagcacctcctggtcttgattgttggggccctcgcaatcattgcactggcccgtcctgccatctgaccagagctcttccctgctacactcttctgtgagtctccagcaggaccttttgcacatcagcaagctgggcagcgtcaagtgcctggaatccaccccatgccttcccacctctggacatttgctcatggttcaattcatggccattgaacttgtcttggtcagttttctttcagctctcagtgatagacacattccacaatgacctacagagaaaaaaaaggctcaaattgtatagcaaaccactacctctactaaagtaacctattgttctttagaactgaagaccagaggctgtgggacttcagtcttatctgggatgtggtgctgacatgatgttcccaaaactctttctatctgtgtccctaactctcagatttacttttctctgtgggtgttaatctcaagcagatagcaaaggtagtttctgctctaagctcatgaagttttacagttcctaacgagagaggaagacagaggcatgctctctcccagggtctacatgtgaaatctcattcagggtttctggttgatccagcactggtcacatggcccagccacttggagtcagttgtgttgtcagagcctgcaccgcaagcgcgttgcacagacaggaacaggactggccagggagggaatctccattaggacaaagtggttctgcagaccttgcagcgtctcctcctcaaatgccttttccttacaagagcttcctctcaaaatgcacccctcctttcaggtcccattctaatgctgtcacctccaaagcagcaacctcatctacctgtctcaactccctaaatgggtgactgttcctgcatctgaatttccatagcattatcatgacacaccatcctcaccattgtcactatcttacctgtaatcatagctgcttgtgatgagcagcagctggaaggacagacatcactgccacttaaaccagctccaacaaggcagagatgaaatagaccggaagaaggggcaaggctgtgagggccctgggagcaagcagggacacctcccatcactctttgagggccctgggagcaagcagggacacctcccatcactctttgagggccctgggagcaagcagggacacctcccatcactggctgccatacagggtgaaaacaatacagcctgagtgcccacattccattccagcattccccccagtaagaacaaaacaggaagggcccaaggaaaacacaaccagcagtgaagtggagctctgtcctctttgctgtcctcactggccgggtgcacaggccaggccctactgaatactactacctaagcagttacaccatggccttagtacccccgcccccgagagcagaaattgtaagcaaattgtccatcaaggtataatggcaaaaggcacaaattaggaccaggccaatggtataaatacacctgcctgtcacccagcccctagagctccttggagaagcctgagtcctgtgttccacggacatcagtggcatagaggccctgagttggactcaggttttcctcagggactgggttttcctcagggaatggggcaagttcctgggggccaaggatgtcttctgactggcctgcatgagggcttcaggaggtgagttgttttatcctcctaagaagccgccttggtatcccactggccttaagcagtcccagaatacccataatttttcctgttggagaccctcacattcttctaagcctcaccttcatacttctgtgactactgaaatatcagccacggctaggttcagatttgtttttttttttttttacttttttttttttaatttgggacagagtctctctctgttacccaggctggagtgcagtgatacaaactcagctcactgtaacctctgcctctcaggttcaagtgattctcctgcctcagcctcctgagtagctgggattacaggcacacaccagcatgcctggctaatttttgtattcttagtagagatggggtttcactatgttggccaggctggtgttgaactcctggcctcaggtgatctgcctgccttggcctcccaaagtgttgggattataggtgtgagtcactgtgcccagcctcagatttttttacaatgatgccacattgcaattaaatggacttgtccctactgaacagagccctctgctgttgtgccctggagccaggttaacacgcatgtgctctatgccacgaagaacacccaccaagctgaggggccctgcaggcattcacatgggaaactgccattgcgaatggagtgagtgaggcagcttaagtggtgggaggggtgcatgggaaggggctcctgagcaggaccttcaagggtgctagagtttggcagagacaagagtaggagcgaagaaagtgagagtctcatgtaaaagggcaaggtcaccttcctgaacagggaagataaatcatagtggatattgtacaataaagattttattcattcatctatgacaaacttttactcgataccaaccatggcctgatgcaaggctgacaccatgggatacagaaatgcttttgagtgtcagtctggggagagacaggcatgtgagcaaataaatgagctgggtctgtcccatgaagagtctagaatagtgcagttggttagcactctctggtgacagaaaggctgtctatctataccatccaatccaatagccacttgccccatatggctgttgagtgcttggaatgaggcctgtgagattgaggaactcaattttaaattttatttaaccttcatctattttaaatttaaatagccagccacatggggctagtggctaccatattgggcagcacagggctggaggcacatggtaagaaatttatatccaataactaataggaagacacattgattagtttttttaaacctatatattaatcgtttcacaagtactagggcttcaatacatggtactgcataaataaagcagtccttgccttcaagtcaaacacatcaccttatcttattgttatctgagaaaatgcaaaggagcccatgggagcgagaggagggacacttcattcagcttcaagggtgtcagggagagttttctgggagattcgatgattaggatgattcttgaagagttaatgggagataaccttgagaaggaggagaaagctatctcaggtggaggcaacaaccccatggttatcagagaagcagcagcatcagggagaggtcagagtattcagggaggtatgtgggcctggagactcgtgcatgtggggcaaagccattcagaatgaccctcggagatgggcagggcaccatggggcttttgcatggggctcaggcctcagatgactttttttaaggtcatggggagtcatttgaaaattggaagcagacacgtgagatttctgtttttctgcttccatttcagtattttccaaaaagcagtaatgttgctggaaagaaggagagcagtgtaagagtttttgtttgttttattggttgcagtgagatctggctctgccacccaggctgcagtgtagtggtatgatcatagctcactgcaacctcgaactcctgggctcaagcgatcttcctgcctcagcctgtcaagtgcatgccaccacacccactcaaggtttttttttgttttttttttgtttgtttgtttgtttgtttttttgataaagattgagtcttcctatgttgcccagcctggtctcaaactcctgggctcaagcagtcctcccacctcggtctcccaaagtactgggattacaggcatgagtcaccgtgcctggcaagagactcgtttgaagttgaatgaaacgaacagaatttggcaatggcttagttgggaaaggagaggttagcagggaaggggcagctgcagcatgtccttaggggtgtcaacatttgtgctgaacacaggccactgtgggaggaggcatcggcttgacacagcaatcctgtggtggaggtgtttgtattttgaggttattattctattgttgattcttggagtaataagaattgagagattacccagaagcaatgggcagtgtaataagaggagagggctggagaacaagctgggtgactcccatgtttacaggcttctggcctcagggaaggcctggaaaaaaggatgggaagaagatgctgttagaatccaggagaaagctacctctaagaaagcaaaaaaggcaggctcatagcagacaagtaacctgaattgggaaagggcccagtggccccggccttggagggcagctggtgtctgcagggagggtggctttggcaggagcacaggtgtggttgaggctgaggtgaccaaagtcggattaacacgaacccgaggcacgtagcacagggggatgagtgtgggggtttcttccgggctgctgcacaggccctcctcttcccagacagcagctgctgagtgtcaggtggggggataaaggccagaagcagagatgccgctaagcccacaaacaggtgcccacgggatcagcctcggcgcccgggcgggtcttaggtctgaaggacacttggagactagatgttaactgttggaaatttagtaaactgggccaccagaggcttaattcactgctttaaagtctgatgattggaaattaacctatgagaattgtcagattacattgaggtttgatctcccgtgcacttacacaaatgcacacagacacagacacagacacaggcatgcacacacctcttttatgagacagataaaaacccagccacaaagatgtcaatgccacacatctaagagcctgtcccataagtaatgcacagggctccagcccccgtgggaggaagataattggactgtaaaatagtgaagggcacggctgggtcaagagagagtcccctaaaaccaaattccagatgatttccatattctgaatggaaagcctgcataatcattatttttaaaacatatcgacttagaaataaaatatagaagtcaaaaaatcaattaagaggactaattcaatgaagagtgttttctggtggctatttttctttttattaaagtttttaatttttttattttttgggcacctagtatatatttatggggtacataagatgttttgatacaagcatgctctagtgactacttttcaagagttaaactgtggactccagagtctgaaaataaagtataatttttgagaatgttcaaattatagttttaaaagtctttggcccattatttatattttttattcttatttggaattaagcacagtattttgttttttcaaaaatttaaacctgactgagagctaggttgtcatggaccattggttatttatcttcttttgatgatacttcatttaataacaaatcagtgttcctgtgtctgatagagttagatgaattaatcaagtcagtgtttattcctccttcaagtggcatcttcttaaaggtagctttgcaaaatgcccaattatttggacaacttaaaaaaagaactatggggccgtgcgcagtggctcacgtccctaatcccagcactttgggaggccgaggcgggcggatcacgaggttaggagatttcaggccatcttggctaacacagtgaaaccccgtctctactaaaaatgcgaaaaattagccgggtgtgatggtgggcgcctgtagtcccagctactcgggaggctgaggcaggagaatggcgtgaacccgggaggcggagtttgcagtgagccgagattgtgccactgcactccagtctgggcaatagagcgagactccgtctcaaaacaaaacacaacagtttctcatatgcaatgatccccacaccgaggtatcaggtaattgtggactgtgccgttcactgtgtactatcaggaatttaggtaaggcagcaaaagagaagaaagtttccctagagctccataccgaggtatcaggtaattgtggactgtgtcgttcactgtgtacagagattggcagggtgtgagtggcagaaagagcttcttaggcagtcagaccacctggctctgaatcctggctcggtcacaaattaattatatggaagaaaaccttaagcctcggtttgattttctcctttaaaaagtgagacaaataaatgcatttatttctcagaagatagttgtgatgcatctattattttatgacatttttgttcatttttaaaaggtcctgacaaattttaagtgttttatgtgatcagttagatgacatgctaataggcaaaaggcttgcctctaatatacatgctgtcaaattttccatcagcttctatatttgcttctctaagatttttttttcctgaatgacataattaattaatgaggtcatgcaaaattcttaaggaaaatagctaagtcagtttccttcattaaaatccactgtaaacaaagacggccctctgtttaatgcttagtttaacagaaaatttaaattagcacagataattcttcacatcatttggttaattgaaggtatgggaaactgtatttgtagtgttcactcaaaccattcccaataagtgaattacccatgggccaaactctggaaattgccagatgaactgtattatataaagatagtatggcatgaatagctgttctttcatattgcctttaatccatcctctttgaaataatagaggcctgagatacatcagtgttattgagcaggaacgcttgaatataaaaccaatcaagacaacatatagtatgaaatagtagcttatcatgtatgtgcatgcatgctattttatttgttttttgctgataaaggtggaatgatgttatgatgaatttcaccatgaaagactgaaatagagcaaacaaaacgtctcaatcagggtttgccagggttattcctaatgagttattcatactggttgtatttttttgaccattgggatttatttatctgagggctgctggaaaaaggagaaagggaagctacgtcatttgccttctgtgtgccaggcattttctctttctttatccctggaataaccttgtgtgggaggtttcattattctcattttacaaatatggaaactagcttagatgaagagagatggagtgaccctccgaaggccttgcagtcagcaagagttcgaagcggggtgagaattcacgtgtttctgatttctaaagccgtattccttccactgccctggttcacatgttagaatgtcacatctttatccttcagacatagtagctcagtctgcatcagactaagatggggaaaaacttgattcctggaaatttccaaacatacggaaaagtggagggaattaggcgataagccagttgtacccatgacccagctgtataattatcaaggcttcggcaatctcgtttcatccatttcactaccactatgatttgaaacaaatgccagatatcatttttctccgctaaaaacattttattatgttggatcctgtttgtgcccgtattttatactaagccttcacataagttatgttctaggatgtcttcaaatgagagtaaaagaggacaccgttgtcttactgctggggaaaagagagggggctttcttctttcttcaacttccctctgtgatacaagggaaaaatgcagctaaattagtctaaaatctcgatcccttgaaaacagaaaaatcaacagttttaagcaaacaaatacaatccccctagtagctaatcattttcatccacgtgcctggtacacatgctaatgttggagggaaaaaaacagggtgatgtgctttttgagtgtggacaccagagggcagagtgtactgattagagtttcctggcattgcaaaagtgcagtgcggcttggggaggaaaagcagtaggctatgaaacattattccttatgtcaatagaaggaaattattacataagggaaaactggcaagatggaagagcttatatccgcttgcagttctgttcattccccctaaactccatatattatttcaggattttcatgagaaaggctcttctttgaagaatcaattgcttatccatggtgttagtttatatgtttgtatcatgataaacatcctatccagaggtgtgaccttccagaccttgctaacagcatgctgctgctttgcaaagctgcctgcgctttgctgctcacctaaaggaggacttctcaataatagacaggatttgattcctttttgtcatgagaaagctccctgattgtgcatttgtaatgcatgaattgcacagatctccctgctgagaggcttacatcacagagttggctcactgtttccagtatcattcttccagcccaacagtaagcactggcagagagcaggtagctgcctaccctgatattacgggacgtcaataggctcttgcacgcaagtgtggtgtttttcattgcacaccaagggttattaggctgtgctgagtcagatggaaataaaaatagcctggaacctgtgcccgtttgtttgggggacttgtcccagcaccatgctaatgagcccaagggcttgggcttgatgtccctggtggttccatcagagcaacatgaaggaaagcaactgtcggaagccacaggccctcacttaatgtggtttgcagagtggtaagtgatggctcttcccacgggtatggttgtctggcacagagagagccgggggacccacacgctcacgcagttcctgccagcaactgtgagacatgacgactgtgacttagcagaatccagggttcatccaccctcctgtgagtcctcctgctccccgttttgctgccatctcgggccaatatctgcaggtgcagagaccctggagtagctgcacctcagcctcatgtcctctgtggtcccttaattgcccaaaagaaagaatttaaatgtaaagtcgctctgtgcagcgagcatgttccttcgtgccctgggcggcctctctgacagccctgactctggtctgtgacgctgggattgtggctgctttcaggcaccgtcatggccttccatggtcctctgtctgcctttgtctccttccttctgtttaggatgccctttagtgggggaactcctggtccgccttcttctctaaatctgtgctctctaccaaggattttccaagcctgcgcttcctcctgtcgtctcctttgctcctctccgtggctctggctcctgttccgcagcccctggacctatatctgtgatcacacttagtgttttatacatcagttattcacttaagtgtcggccgtgcccaccagcccagaagactcaaggacgagtacttttctatacttacctttacacaagatagggtctcagtactcatcgcgattaatacatgaatgaacttcagcaaaataattgcaatgtgtaaaggccaagatccagaataaaacctttcatttcttagctaaaaatctccccacatccattagttttacatccttggcattaaagatcctaaggagaaattggtattcctgtctggaaaaacttgctgttacttaatgtatttgaaagtaagttatttttaaataaatatgaaaccccatctctactaaaaatacaaaaaattagctgggtctagtgatgggtgcctgtaatcccagctactcgggaggctgaggcaggagaattgcttgaacctgggaggaggaggttgcagtgagctgagattgtgccactgcactccagcctgggcaacaagagtgaaactctgtctctaaaatatatatctatgtatgtatgtatgtatgtatgtatgtatgtatgtatgtaagtatctatctatatatctccatatatacatatagagagagatatatagagatctatatagagatagagagatatatatagatatctatatatatctctctatatatgtatatagatatgtagctatatatagagagaaagagacctggagaacatatatactcaacaggtgcatgtcataaccttcggggaaatagggtgggaaggatgaagatgatattttatgtgatctgtactgtgtgagttgtgagtttctgcatatattaattagtaaaataggtaggagcaaatattatgaaagcattaaaacaccaagactaaccaagacaatcatgaagaggaacatttctgtctaactagatggcaacttattataaagtcttagtaattctgatgactataccccacatggatgcagagacagaataagtaaatcagtggaccaaacagaaacaattggtcatatttacacagttcttgttaccagctgggctgttttaaacaactttccaatataaattcatttaatctttgcagctgtccatgaagtaacgtttataggtctccatttaatgctttaagaaaatagaaaaagaaaggttaaattgctgaaagagtcacataagaggaattggcataagagacacaccggctactccctgggtgtgaagctttatagccacagcagggaggggagtgtcaagaaccagggcagggaggataaagaccccgctgagagttccagctcagtttatgattggtatatgcctttcataagcaagtcactattttcttgaaaagaaatggaaatcaagagatgcatgtgttgtcaaagcgggagaaaatatttgcaaactatgtatctgacacagtactactatccagaatgtacaaggaactcaaacaaatcagcaagaaaaaaacaaataatcccatcaaaaagtgggctaaggacatgaatagaaaattttaaaaagaaggtatacaaatggccaacaaacatatgaaaaaatgctcaacctcagtaatgatcagggaaatgcaaattaaaaccacaatgcaataccaccttcctcctgcacaaatggccataattaaaaaatcaaaaaataatagatgttggcatggatatggtgaaaagggagcacttctacactgcttgtaggaatgtaaactagtataaccactatggaaaacagtgtggagattccttaaagaactaaaagtagatctaccatttgatccagccaccccactactgtgtatctatctacccagcagaagataagtcattatatgaaaaagacacttgcacgcacgcctatagcagtacaactcacaattgcaaaaatatggaaccagcctaaatgttcatcaaccaaggagtagagaaagaaaatgtggtatatatacaccatggaatactactcagccataagaaatgaatgaaataatggcattcacagcaacctggacagagttggagaccattattctaagtgaagtaactcaagaatggaaaaccaagtatcgtatgttctcgcttttaagtgggagctcagctatgagggtgcaaaggcataagaatgatataatggactttggggactcggggggaaggctgggagggggatgaaggataaaagattacacatggggtacagtgtatactgcacaggtgatgggtgaaccgacacctcagaaatcaccactaaagaacttacccatgtaaccccaaaccacctgttcctcaaaaactattgaaataaacataaaataaatttttaaaaaagagatacatgtgttgaaatagacaataactctcaactgtaccagaacctacacctccttattttggcaaattattttaatgctcctttcctaatttaaattaaattcataggtgataaaatgtatatgcatataccactttaaaagtttcaatatataggctaaataaaggaatgaacttataatccagttatctgtccttcagcgtgtcactgctcaggtcctgcttgccaggtggtctgcagctagggcactgacatctgtgatgaagtcagaagcttcttcctatgtgtaaagagtaaaactgggtttaaaatatttttttttaaaaaaaaggctgggcgcagtgcctcacacctataatcccagcgctttgggaggccaaggcaggtggatcgcctgaggtcaggagttcaagaccagcctcgccaaaacggtgaacccctgtccctactaaaaatacaaaaattagccatgcacagtggcgggtgcctgtaatcccagctactcgggaggctgaggcaggagaatctcttgaacctgggaggcggaggttgcagtgagccgagattgtggcaatgcactccagcctgggtgacgagggcaaaactccataacaaaaataaataataaatttttaaaaagcagaccagaaatagttccatataaaaaatataggaaaagggaagagcagataatacagaagaaccttagaataaagcctgagattaagtaataatagattagttttattttgaaaatgaaaagaaaatggggacacactccatttgaaatacaggatgcgtaccaaggtggatcacagattgagaggagaaaatgtgtgagattctccactgatagccaggtgtggcttcttctttttaagcatggcgtgaaacaaattatgacatggatgatgagggcatgaagtgtccctgggatcctaccacctgacaaggtgtaccctcagtctccaatgcttaataaatgccttgtaaactgtaacctctgatacttaatgaggaatacagcgctttgaaacagaaaccgaaataggtctctagagaagttgtatgataagatcctgggggcagtgtcagaaaaggaccgaaaaaccacagattcctccctccaggaaataatttcaatacttaaagtttaccatgtagatttcttgttctggtgctataattgtgaagcatataggaaacactataaaatgttttaaaacaatacttttgataaactttattaagacctctatgtttcatgtgtttgcactaaaaataatgtttgcttctaagaatgttcctatttgactaaggtgatttaaaatgcctttgcattgttgcactgtttgtgtagtgattgtaactctgtactaaagccaattaactttgtagttggatgggttataaaatactcactagacacagtactccatagacaccatattcaataatagacacaatgtgtagaatgaagaagccagcgtccacctctgcaacgagcttgtcctgaatccctggaccctttatttttcatcccataaaaactttcagtatcattatgtactgaagtactccttatttatagttctgtggatttattccaacgagtctgttgaaaactgggatgtggggcacctacacttctcaccgtgcaggatctctacccattgcagggtgtccagccccctggcctctaccccaaatgccagtgaagtctaggattcattgtgacaactgaaaaactctcctcatttcaaaaatgcttcctaggaggtagaatggccctgttgagaaccttaaatagattatagattttatttattattattattatttttttttttttgagacagagtctcactctgtcaccaggctagagtgcagtggtgtgatctgagctcactgcaacctccgcctcccgggttcaagcaattctcctgcctcagcctctcgagtagctgagactacaggcacgcatcaccatgcccagctaatttttgtatttttagtagagatggggtttcaccttgttggccaggatggtctcgatctcttgacctcatgatctgccctcctcggcctcccaaagtgtcgggattacaggcatgagctactgctcccggccaatagattatagatataatttttctgttattatttctttcacaaaaccctggctgtacaagtatcctctgtaaacttagatatttccgacagtgtgtctacttccttccttcatgatctcaactctctgtaaattacatgtgaatgcattcaggactgtattttatatatcatctctttcatgttttgatttgctttttccaagcagacattaagtgtgctgaaggtagttgtgttgtcatctgctttcattgaatccttcagaaattttagcaccacaatgagattctgaaaaaagcacagaaaaggggcttaatatagaatgtttaaagaatatttgttttctcaatttatattacgactttcaaacttcagtgcatatgtacacacacacacacacacacacacacacacacacacaccattttaaggcattgctagactcacatatatctttcaccttgaagatgaagcaagattccaaaatgtcagaaaatcttgaaagtgtcttagatacgagcaatatggggagagagccagcaactgagttattcccaagctcatttagtgacaaagttgtgggttggttaggcttgttagagctcaacaaagcacttagtgaaggaaatatgaaaattagaaaccactgtaggatataaattaagactatttggaggctagaaagatttggggattttttttgttgttgttaaaatatctagccaactcctgaaaaataatgagtggttgccatagcaactgtgttttcgcttgacacacgaaagaacatgaaaagcattggaatcaaggaaagccacctggttttagactttaattttggagaaacaaattcatccaaaatgatttataaaacaaaccctattttattttccttccaaaatgattgtagattttttaaatttttttaaattcaaaacattgagggtatctcaaaggaagtgaaaatacattcttttccaaaaaaaaaaaaaaaaaaaaaaaatacctgggccgggtgtggtggctcacgcctgtaatcctagcactttgggaggccgaggtgggtgtatcacgcggtcaggagatggagaccatcctggccaacatggtgaaaccctgtctctactaaaaatacaaaaattagccaggctttgtggtgcatgcccacagtgagctgagatcgcaccactgtactccatcctgggggacagagctagactccatctcaaaaacgaaagtgcctggtcgtctttccacacaactccgtttccactcccataaaatgctacgttagctgttttgagggtagatgcccttagactgccaactcacaaagttttattgggcacctgttacctgttcagcagagatttgtaaaaaaagacacatcaggtggcctttgcttgcaagaaatcagcctttggaacctgtggagaaaagttaagtactgcgtactgcgcaaatgaagggtgggagctattgaagggaagagactcaccccgaaaacccaagaatggtcaaacgagaggcaaggtggagcctgcagttttcactggaaggattctagagtgagtgattctggggacctagagatgggggataacgggtgaaaggaacaagcacggcccctttgaggtggaaaacagactggtgggccagggttgggagggtgtgctggggaagtgttgtgggcagaggctggaaaatgaaattgggctggggttaggagacaggtgaccgtggaagactgctctgacaatcagagtctggactttgctcctctgcaggatccctgatgcccagatggacccttcgatgttcctggcccacctgcgctacctattcttgccccgctctgctctagtatttacaactgcacgatggcacagttggtctctgggacttagaatttgtgttgcaaacacaagacctggagaatggacctggtctgtgatatagtgtgtcagtcagggacctggagaaacagaaggggatcccaaataagaagacttgaaggaagtttaagaaaggcaccaaatacaatttgaaacttgtgggctgggaagccacacgagatagcgcaggctgggggatgtgcaggagctgtcatcagaagccggaagtggaacatgttatgaaaaaggtcacttttcataacactttgcatggagaaggagtacaagggaagtcaagaggacccacagtgggaagtgggctgtgaatactctgatcctacctcatttactgccagtgcatcccttggcctaagtgaagtaggagcttgggagaagattggccgttgactctaatcctgctcccaggttcctacttaatcagcatccaagatcaaggtgtggagttgacagtgacatctcggacttcaatccaccatgttgacttctgattaaccccagtcctgggaatacctccaagaattctactttatttacttctcttatgtaagaatgtttaactcaccatggatcctgcccttagaccaaagcgaccttgatgttattgcacaaattacaggctatgacacatataccattcctgcctgtgctagaggattgcctttaattgcttgctggagcacatatgcttttccctatggtagataagccttgggtctgggagtaagagtgcagagatctacctgtcttggtgccacccaaggtcatacctccgtctgtaagttcccctttcatggaacacaaggtaaacctcacaaagtataaggcagatcttttcccatttcctgcatgtcttctcaatacctgtgattgaaacatgcagtggaaatatccatgcccgtcttgatggatgaagctaactggctggtaggtcgaagccagttcgaggaacaggctaggaggtctgcatggaacctgggattggccatcccctcatgagggctctaatgggaagatgatgccttgggtgtgcctggatgctgagaaaacatgagatgtgtattaccttctgctctctgtatgtaaaacagctgaagctaaatcccttgagatgtttctacatccatctatacctagatcttggaaattttgcaaataagcagttgtcagaattttgagctatggcttagggtattaaaaaatagaaagacaagggaagagggtgttgatggaggcttgagccacttagcatgacctagcccctgatcagctgtggttagtccaaatgagccagtatgctggggcagagagcaggatggagtagcaaaggccctgtagtgaggccctctgtgggggatgagtgtgcttggtagcagtttgaagcattgtgcctctctttcctatgcactgtgatcagtgcacaggaatgtagaaagggccaagcctttcaacaccttagactctgatgcctccagggtggattcactgtgccatggaaaaccacataacatcatcctattagcgtacttttgagagtagatgtgctattaatgatgctaaaacaacagacatacactaccagaatgctcctagcaaaatgaggacatgtagtcaccctttcctctgctccctccccaccacctgtgccattagaagctggaggagggagcggtcactgtggcatggagtaggctgggcaatgaaggcttctaggaaaggcgggccttggttcatgatccgtggtgggattcatgtgggtaggagagaaaatcaagggacgtcaagagcgtggtaatagcttgttactacctggggagaaacatatctgctagagttgccatttagagacatgtcaaaacctccagaaagtgtgtttcaatgccaagtgctaattgtaaaagggaacgtgtctttctgcagttctagtttgttatagaaagggacagctcttgacgttagcaaataaggttgtatgttatggatcctgtggcaactgagtgtatgtgacggaaaatggatgtttactttaaggtcattactgaagactttctggagccacctctttcttggggacgtctccctactgattcatattagaaatcaacttgagtgacctttctcttcaaaacatcagagactgccttggactgtgtggtctgcttggaggacttcaaccctcttagaaccttactctgcatgtgaacacagcagcacaggggcagcgggttccatcgtctacgggagatggtgctcaagggttggagccagtccccctagagagtcacatagcatttggccctcgaccatggctgaataaatgaatgaataaaccttatttaatatatactttcacctgcctgagttgtagaactctgcagaagtccttttatatctcttctacattcatcttcagagccattgtatcataggggttgttttgttattctccatacatcctaatttatagaggagaaaacgaaatccagggaaagctggaaaattgatccagggtcaaacactgaacttatggagaggatggagaggaaagcgtggcttttggagtaatactgctgagagtcaaatcccagttattgcagtgaggagtagcaagaagtcacctaatttcaacaacacaatcatttcaggaatggaaagaacacccccagttccattaaacgacatgaagtacagaaagtcctggctcacagaaggggcccactaagcattagttgccattcctttcttaggtaaccaccgcctgtggaccctcaccccttcctccactgtcagaggcagcataatggctcagtttgcatttcaaggctgatagaatcaagtttgctaatgctggtcctgctgccacctagaactcccttaatgaaagtcagcctccacaaaccttgaggagtattaaaggacagagccctgtgaaggatggtgctgtgtgtgcctatcttttctttttcttttttttttttttttttttgagatggagtctcactctgtcacccaggctggagtgcagtggtgtgatctcagctcactgcaagctctgtcttctgggttcacaccattctcctgcctcagcctcccaagtagctgggactgcaggcgcccgccaccatgcccggctaattttttgtattttttagtagagacggggtttcgctgtgttagccaggatggtctcgatctcctgacctcgtgatccgcccacctcgacctcccaaagtgctgggattacaggcgtgagccaccgtgcctggcctgtgcctatcgtttaactgactagttggattagtgaggagtcggttagttgttgtgcttctttgcagtgcactgggctgctacatggacctgattttgactacctgttctaagggatgaggaagccctccttgcagaagcccatggaagccctccttgcagaagaaatatcccagccactcaggttggcagactctgtgcagaatacccagtgtctttcctcctcttatttatctctcttcaggtaccaggaagtgaaagaggcctatatacatggaagttctgaaggagaatagcgttgccatcctccctacccacctctgagtctctggttcctggtcacccaagcctccatcatgccctcttcccttctcttccttttattttttaataccctaagccacagctcaaaatgctgagcaccacttctcttcagcatgactgaggtctaggtatagatgggtatggggacagctctagggacttagcttcagctgtttcaaataaaggaaaaagcagagaacagggatctcatgttttctcaccagccatgcatgcccaaggcatcttcctatgagagccctgaggagggaacggccaatcccaggttccatgcagtgcctccagcctgttcctgggacaggctccaatctcttggtgcagttagcttcatgcattaagacaggcatggatatttccatgttcttcctgaatcacaggtattgagaggaagtgtgggaaatgggagaacagctgccttatgaatcatgaggttcacctaaaccttgggggctagaattgagatggagcagtgttctgaggggtcccaagaagcctagtataactcataagatgcttgggagtttaaatatgcttttctgtgcagagtctaccatctaagtctctctggtttgaagttggagaaactgaatttgtcattcagctagaaaacatactggaggagagattttaactcatgcctcagaacaaagctcagggctttctgaagcaccagagggtgccaaaggagtcagagcttgggttctgcccattgagaagaatgaagagggatgctggtttcagtttagcaggaggaaaatggtaaaaataacattgaaaagaacaaatagacttacaagggttctcaagatttatctgcaagtgatattttctaaggagactgcgtgtgtcccccaaactccattttcatcatgtcacatttttctcaaaagcatttctataattctagcatgagaagggaagccttggtctaaatgttcatgagcggaaccaagccgcctttccagcctcatcctgcaagcacatactccctggctgcaggtaggtcccctggtagtgtgtagatgccagcatttctgttttaatggtacatggagagaggcgatctaacctaacaacaaattgatgatctagcttgaaaaaaataccaactgccatttctatcaccgtaatttcaaaagcagaaggacattttaacatcaaaaagtgggaaaaacattttcagaacaaatatcatggctccttaattttaaaaagatgccttgggtgcgttggctcacgcctgtaatcccagcactttgggaggccgaggcgggaggatcatgaggtcaggagatcgagaccatcctggctaacatggtgaaaccccatctctactaaaaatacaaaaaaattagccgggcatggtggtgggcgcctggagtcccagctacttgggaggctgaggcaggagaatggtgtgaacccgggaggcagagcttgcagtgagctgagatcgcaccactgcactccagcctgggcgacagagcgagactccgtctcaaaaaaaaaaaaaaaaaaaaaacaggtgcctttataaaaccttgttgtatctctttttcttttgttttaatttaccacaaattcagaagagcttcattatccctagagtaagaaagggaaagaataaagaaaaaaaaagagcttctttaaagaccagcaatccgtggacaggcatttagcagttactgacttagcctacacactgggctgatatagtttctccatctggaatgtccttttatctttcattttatccaattctcaacttcttttccatcccaaagaatatcccatcgccactctcaagcttttccggacattctgcagtaatatctacctcatctgaactgaaaactctcttgcctcttgtactcaattggcctttaccgttcactgtcttctgacatctcttaaatagtgatgagtcattaatgcatctcgccaactagacagtaagcattttatacctctttttaatgtctattattttcagaaaatatgtgatacctaataagtaagtttttaaagtttgctgaacgaacacagtaagttctttgttgtactccttgttttctggaactgtgatgttgtttatgtcgagtcccagaagttaaggcagaagggaattgagaaactgaccctgaaattatgtcataaaaaactgagagttaaaaaagaagccatggctttctattgcaactttaactttcctagtatgcttagtacttattttttatttttatttatttattttttgagatggagtctcatactgtcacccaggctggaatgcaatggcacgatcttggctcactgcaacctctgccttccaggttcaagcggttcttctgcctcagcctcccaagtagctgggataacaggcgctcaccatcatgcctggctaatttttcgtatatttagcaagacagggtttcaccatgttggccaggctcgtcttgaactcctgacctcgtgatctgcctgccttggcctcccaaagtgctgagattacaggcgtgagccaccgcacccagccagcatttatttctaagccaaatcaaaatatagacctttgatgaaggtgttaagaaaacattgcattgtcctggttatttagagatagagacataaattctctatgattatttctcccaaagatcttggaatccaatggatctgagtcaggtcaagatgaatgaatacaaatatgagaagggcatagctcatcagaaattcagagaccctgggtgagcagggttaggcaacttggagaaactttctagacacaggagccatagcactgtaactaaagaaggaggaaaacacagcatgccgagcagggtatagaggctgcaggtgtgtttttccttggctttcatgctgtgctggccctgacacaggactgactttacccataaagaaagtggcagcagcaggaagggcactgtggtgagccctggtgaatccacatggcacttggaccaacccctcagacacaacccctttctcattctgttccatctgctgccctacacgatgttccatttcagggctcgtttctgagcatggaccagttgctaggcacagttctgcagatatacagtgagcagaaacaaccacagagcttactcttttttttttttttttgagatggagtctcgctctgtcacccaggctggagtgcagtggcacaatctcggctcactgcaacctctgcctcccagattcaagcgattctcctgcctcagcctcctgagtagctggcattacaggggcccatcaccacgcccggctaatttttatatttttagtagagacagggtttcaccatgttggccaggatggtctcgaactcctgacctcatgatccacctgccttggcctcctaaagtagagcctacttgtatattgctaagggcccagtgaagaagccagggatctgttaaatatctcacccacacatataacattacacatctgaggactgttgtcaaatgaaatgatgtggttcagggagaccaatgagtgggatgtggctgctgagaatgaggtgcagggtgatgttacatatttttttcccaagaaagggatgtgtaggctgacagctaaagtgtcagtaggtgctcactagtttggaacagaagagaacattgttcatgcaaaggaacagcccgaatgaggctgtgggacaggagggagtgtcacggggctgacagaatgcccacttggctggcacacaaggaagggaaaggagtggtgtgagatgaagctgagcaggtgtcagcaccaacctcttgggactttgcagagtatggcacagattttagcttcattataagagtagcaggaaggcactgaagagtttaaattggcaagtaatgggagctgaactgtgcttttcaaagactactctgtctgctctctacagctgaagaaggactgaatatgggttggagggagagagtgagagcaagcgtagctgggagcaaacatggagtgtaagagcagaggagagaattagccgcaggccagggaccttggaaggacacttctcactaaaagccacactcagctagagagcctttttaacagtgagtgattgttcttctctggtgtttctctctgtccgtccctaatccaagccaggagagaatgaaggctcttagtttaaaaggtcctctggtcctttgctgccccgttcttgcttttctagccagacatggttctctgaggatttgttaaattttatagcccagtggtcaagtaaacatggggtggtactcaaagaaactcacaggtatttattatccaaagctactgcatttggggattattaaatacagacatatagacacatatgtatgcaaggtcattggagtgacatcccatcctgagaacaggggccaccttctacaaatgccaaaaatgcacttcgcacagtgttggaaatttcatcgggtgttcactgaatgcacagacctgctgcagagcctggttcttgtgtctcttgtcttcctgggtgtgctgggatggaggacagattcttatgtccctcattggaatctaccctctcagccagtcttgtgaccacacttttggagtgatggagtgatgggaagcccctcgtggcacagcacctgccccagcaccattggctgaaacggaaacaaccatccacttggcctagcagagtccttgactatcttttagggctttgctctgggaggggctgtgctctctgcctgcctaatatccccacttctggcccagtggggcttgggctgcagtagctgcattccattctggcccatcacgtggcaacaccaaccacgatgcctgccgttttccctgagatgttctgtgccctctcttctgagacactggtggctttctgagaactgctgtatggtgaactccatcttcaagggttattggcttccaaacaccatgacttgcgggagccccgttccctgctcatcagtgtccatgcaattcaggcaactctccccagctatgctagttacttccttcatctaaaccctgtttggaagccctgaagttcctgcctggggaagtcaagtaaaaatgggaggtatgggacttgatagcagcagatgtgcaaaggtcttacaggttacagttgagtctcagtgtgagatgggtcactgggggatgtggcccctgggcagctagtgctatggagtctgtagaatagaggcacagtgatgaccagttatctctggagcactgtgctcagttctaggagacacatttttaagagaaactcgtgctttcctgaggaggtctgggtctgtgctctctgatatacggtagcctctaaccacctgtggatatttaaattttatgtaattaaaattaatgaaaatttaaaacagttgctctggcactggccacatttcagatgaactggagccacatgtggctccggctggagtgtcaggcagcacagtggagagcatgccctgtcctctggaaggatgtggctcagagcacgtccagcccagaagtcacagagccaggacctcatggagtgagaagtagttgaaaacactaaagttgtgtaccctacaaaattgtcctcagacaattcagaatctatgtcacagaagcagaattggatttctcaagagtgactcacaacagcataacttggattaactgaagggatgtaaagagaaggttttagctcaatgcaagtccaacatttccatcagaagtgttcaaaacgtggaatgcgagtctccaggaattgtgatttttttctttcgtttaagacgttcaaatagagactgctgtccaattattgccaatgctagggagggcatttctgcctcagatggaggtagtgaggtgtcagcaaagaatgtggattttagaactaggtagatttaacccaagtcctggttctatcattttctaacttaatggctttgctcaactcaccacacccctccgttctccccagtaaagtgaggacaatactaattgtctcacaatactgtgttgggtgttaaatgagaccacaaagtaaagtatcaaaggcagtgcctgtcccagagcaggtgacttgcactaatcagaggctcaccctgccttgctgctccacacacacgactgactgacaacatccgtgacccacaacatccacagctcattcccacggcagtcctcacgcaggcaccaaaactctaccccactcatgaaatcgacgtgaaatgcaaggaaatcagaatgtggttatctgaggtatcgactttaatcttctctggtttatttttttaaataaattagttacagagcgagactttaatcattatcagtagcagatttcactagcacaattatcaagtgtcaaaaccccaaaggtgagaatcaccgttcttggagcatcctaagccctgtctacctttagaggttccaatgctggcatagggttcaagaccatatgttttattatgaggaattcaagtgagaccagactgttttgttgtaaatactataagaaagacaacatcctttcttctcctccatttctatgcctgtgaagatgtgatgagcaagccttggaagcctcagttcctcagactcttccaggcatggggccatggaacttggcaaaagcgggtgctgtgtggatctcagtctctggagccattcgttgggtcgtgagcagcaaagtagccttcatctttcccagtcttcacacttcgaggaccctcactgctggtggggagggggtttctgctctaggctgtggtaatgctatcccccgacctgcaaattcacacaatgagccaactggccacatgctccaaggagctaagatgctgttggtccacaaacaaaggttcaggttctgtgtagcttaggatccggttgctaattggcttgaaacatttaaatcctcttgcatttagttgaatatgtggatatgcctattgagaagtatgttatgaaatctagggtttgtattcccatccgtaacaggaagaataaaaccttgaaaaatgtttcattttaaatacagaccccttgtgtatcaaaaagtatatttttttgggaatacaaagccaccaccaccaccaccaccattgcccatagaggcgcctgcagaggctggacttgctgcttctggtccgttgagctgagaagcacagaggttcagtgggttgttgagggcaccagggaccccaggtggaactggtaagaaaagctgaatccaatccttggcttttactcaccttgtttaaattactgtccttaagctttttccatattagcctggagccataaatagtttgtgtggctactttcaaaattcaattctgggccgtttgcggtggctcatgcctgtaatcccagcactttgggaggccgaggcgggcggatcacaaagtcaggagatcgagaccatcctggctaacacagtgaaaccccgtctctactaaaaatacaaaaaaattagccaggcgtggtggcgggtgcctgtagtcccagctactcgggaggctgaggcaggagaatggtgtgaacccaggaggtggagcttgcagtgagccgagactgcgccactgcactccagcttgggcaacagagcaagactccttctcaaaaaaaaaaaaaaatcaattctgtgcaattcagtcgtatttattgggaagcctttaggttcccagaagaactgagccaaccttgaagggaacaggaaagaaacagagcctgtgatcagtgggcactcacagcaaataggaatcctccgcctcccctgcttagaaacctccagcaattcctcaggggtgcaggtagaatctcagtccagcagccaagggcttacgtattttgagcggtctatggctttctgttgagcagacttatagcttctcatagctgggcatatttctatttcctgggttatctgaatgcatttcttgtaaccctggcagaagaaaagtttctatcagccctccttgtaggaagaaaatgtgttccctagtttgtaggcagcagagagcctgctgtgttagttgtgtcccgtcagaagcatttgagaaagtctctcgcggtataacaatggcagttttttgcttgagggacagagagagagcagaagctggtgaatctgacaggcaagggtccctaagagaaaggataaggtccctaagaaagggccccctgccctgccttcctcacctcctcttccccccctcaccacgtggcctcaggagatagggcggtgtcactgcctctgctgaccctcccgatgtaccagatgaagagaccgggtcagtaacgcaaggagttgatgtggacatccactgcccagcattttgttcatcgtgcagctttataaactgtccaaagcaaggttcagaagaggcaggattttgcaaaactctcacatcagttccatctaggacgtgtggacatcacagtgattgggatgatgggctggctgacccttggtggttctcaacaatttccaggatgttgcatttatttatccatgacatgacatcaggggtgggagctgtgcttatgcagaaaggggttctcacagactggaccatctgcctacctgctctcccacctgtgtattgtatctgtttatttaggtggaattttaaatttagaaaacagttgcaaaaatactatgacctgtttatatcctttactcagatgaccaattgtttacattttgctccacttactttattattttctctctttctgtatttaccaataaaaagagcattttcttacagaggcacaggaccgtgaccagaatcaggacattcacagttggcacagtatcggcgtctaacctggcatcaacattccagtttcacctgctccctggcacactgtggaccactgccaccttggtctgggatccacccaggcctccagtgtgtgtagttgctctgtctccttaatttcctttcaactagaatatttcttccctctttctttgcctgttatggcctttacatttttcagaacagaacaggttttctgtacagtgcccatcactatgatttgtttgatgtttcctcataattagaattttggccagaatcctagagaagtgatgttttgtccttgccatgcatcctatcaagaggcacgtgatatcagtgtgtcctgctggcgatggtcattttgatctcttgtttaaggtggcatctgtaaggttttcccaccgtaggttgctctatttcctttgaaatgaacaagtaattgtggggcgattttttcggactatattcatatcttttgactcatcaaattttcacctcctagtttgggcatgcattgatgattcttacccgagtcaagtattattacaatggttgtcagatggcaatcttctaatttcatttctccgtctgcgcccatcagttggcattctacaaaaatatggagccgtcgtgagcttgcgtctccttgtgcaagagctgtggctatgctgagcttctccacatatttccaactttagtacatgggcaggtgaggcaagcaccactcttaccttcgaacaccacacacacacaccacacacacatatcacataatacacaccccacataccactcacacagcataacacaccacataacacacatcctacatatgacatcatacatcatacacaccacacacacaccaaatacaccacatgccacacaacttacataccacatcatacacatcatacacacgacacacagcacataacacaccacatgccatacatcctacatacatcatacacaccatacacacacatcaaataccacaccacatgccacacaacctacacaccacatcatacacagcatacacatgcatgacacatagcacataacacaccacatgccacacaacctacataccacatcctacacaccacacacaccccataacataccacatcacataccacacacaccatataccacatcatatacaccacacacaaaccacacacacaaatgcaaacaccacatacaccatacatacccacacacacaaacactgtataccatacaccacactgtacacaccacaaacacacacacaccataccccacacacacaccatacacacacacacacacacaccatacacacacacacacacacacataaaaaaaaacttctgttgaggctgtgcccccaccacttggagccactacatctccctacctcaacttctttccacttggtagtcctgtcttctgaagttagtaaatgcaggcgtgaggcagggaggcgctttggctgattggcggaaccctgggatgagccacagcatggctgtgtggcacgtgtggtgtgggtgtgggtagggggatcccgccgtgcttccttcccaccctgagtcccgtgtgtgccccttacagtgtgtttcctattaaagttcctttcatgtttgggccaagggtgtttcctttaattcctgctagcataaaagaatgaggttttctgcagcaatttctaagtctgaaaagggaggctctggggtaaaaatgttgaacaattaaaatgattagaaattatctatataaaatacaggtatacaaaatatgtatattgaatcctagctagacagacggtatccccgggagaactcctccttgaggaatgggccatttgcttcataatagatgcgagatcatcctcgggccagttagcatgcacagtttcccgggatgctttgcgatacaaattcataaacattgattgaaaggtcaggggacgttcccatcaacacgcggctctgtcggattgttcaagggaaagttagcactgttgcatgcaggcagttgagttcttagggaagagtgctggccctggtggagttttccatgtctgtgtgatttggtgtggtgtgatatagtcaatgggacttggttcggcgcagggagagctgcatgtttctgctcatgttatctggaaataaggattcgggctctgtgtgctgaattatgtttgcggcgatctcacagttgtgaagaagaggcatggctgggaggcatgttcagagctggagagggtataaaattctcatttcttaccttctctgagggaaggagtgtggagtggcagatttccagtctctgggtcttatatcagtgtcgttctctgggaccagcactgtccccatatgggtaccactgggacgtgtagttgacctctgacgtgcacggcagatgcacggacaggcagggtggtgctgggtgagcattagccgtgtgcagctggtgagcctatgccttcttgttggcaggcctcgctgctgagagtaagttggtgaggacccatgcacgtaggttctcacatgtttccaaaggtcccttcctgcctcactggtgagcctttctcccaaatgagaactcctcgctcttgcctccctttctactttctacatcttcctgggacttcctggccatctcctttctgcatgcatgctgcaggaatttccactccagggagggagctctcagtatctgcacagcccaggtgcaggacatgtgctgcccaggctgggttgctgtctgttgtttcaccctgcacagtgaagagaatggggggttaatgtgtcaggcatggcatgcgtgatttagaaccattcatgcctccaagtatttgaggcagctcctgggatccacatctgtgagcaaggaaactgaggcctggcttaaatcacacgtccaagaccagagttaggaacagggcacctgcctggacccaggttcacacctgtaagcatgtcgtgggtgtgggatatgccttagctctctgagcacgtggcagaaatttggggatctatcacccactaccgtaactgtgacaacgtctccacaggaggagcggcaaagtctaaattaaaagaacgtttcccgcagggggcgctcttttttggatctctctgcttggagatatctctgcctgtgtaggatcaaagcagagggaacctctgtgttttcaaataatgtttttcccctaaagcagcaccagtcctaattgagtaatagagtaacaagaagtagaaaggggaagctttagcagctgggccttcacctggtcttccaacaagccccaactcgacgagagccaaagcaagagacaccatttggaggggaagataagaagtcttcacaaggtcttttccggtgttctgctttttcctgggaggcggccttggcgtgtccctgagacctcctgtgatgctcacggctctggcgctgccatttttcttgggtgtcgtctggtggtgtctgcaaggccagctataatgtcagggctgtgctcgatagcacagaaaagacagcgtcctggaggagagcttgttggagcagatttacaagggagggtgtgggtgtcactcacagttcacgctacaggacaatccctttcactctgggagctgagtcccaggtgagagctaagttccaggcgagaccagggagtcgaggggactggatttctgcttctctcccaggagctgcgggctgggaaggggaaggaacagagctgaggtgtgacatcgcccccggtttcccctgttgcccaggttatagcttgggtggggctgacttcagaggcaacattagaaccttttaaaatacccttaatgatttacatgaattagaacaagaaggcagctgggtgtcgtggaaagcgagtgggatctgggttatgtcctcactgtgcctttttatgcacacaaagatttatctacccatgctatcaacttagtgtgtattatagtgaaatgccgtaaataatctcatgtcccctttatacagataagaaaaatttttcagggacattgagttaacttgataaagttctccagttatcaacctggtaattccagttctagaaaatggcaagaggtaaatgccaacagtgggtatttatataagaatgattatggatcagttaagcaagtcagtaaaaggaaatcgctagtgtgcataaggtgctattgaggcaatacctttatgcttttggtttataaagtaaaacattttaaatcttggtatttgtgctatgtctgcataataaaatatttcataattaaagtcatactttggaagattttttattatataagaaaatctctatattacaacattaagtgaaaacagtgggagaataaaatctaaaactacatatagagaccaaatcttataaacaatagattaaaaatactagtaaaaatagtataatgactatactagatttgctgtctctgtgtgtgaaattatgattaaatgatttctagtttatcctttctatattattccagatgtttcactattaacatcaattatatttataacaacagcagcaaaggtcaacgtgatttatatttttagaaaaccaggtattagtagttatggttatgtagcaaggctggctcaagaaatggatcagactctgagaggaaagacccacggttttgttgggtattcaccgtgtgctccccttgtaggtagaggtgatgggatggacctggcgttcactgcagctgcctgtctccacactgcacagcctgctttggaggacgcccagcctccccttgctggcctcctagcagtctcgtcagtttttcctgcaatgtgagtcactccctttgctgtagcctgggtgtacctggaaccagccaattgcatatccacagtcaggcggccactcagtctcctaccagagtttacaaagccagggtcctacaaacaccctcataagtgggcttattttggcccatcccatgaaagaagaggctgagtctgacaacagcaggagcagcagcaatgatcgcttattccgaggcctctatgtgcagggcacacctccactctcccgccgtgctgcgagccctttgagggcaggacccgtctgattcaacgctattgctccagcatagctggacagggcttcacactggacatgctcagtaaacttgagaacgtaaaacagatgatcgaattcctctgtactccagatgattttgctaaacagaattattacatatttaaaatacaggattatcactatttgaagatgaaattagacacttatataataaattaccccaacacttagtggcttaaaactatgcacatttgttacccacagggtctgggtagcagggatctgggagcagactggctggtactctggctcaggccttccaggagcacgcagctagtgctggctgaggcagctgtcacctgagggcttgtggaggcagcagggcaacgtccaggctctcttatgtggcctctggcaggaggcctcgggtgctagccacgtaggcccttcctcatgatgtggcatttggattctcccagaacaagtgactgagggagtggtgggagggaggttggtggagacagcagcgtagccccttcctgtgatctagtcttatgggttgtgctcgctcacttctgccatatacattaggagcaattcataaaatccagcccagacacaagactccacctcttgaagggagaggtattgatatggttctgctgtgtccccacccaaatctcaccttgaattgtagctcccataatcctgttggattatgttggaggagggaccctgtgggaggtaatttaatcgtggagatggttaccctcatgctttctcatgatagtgagttctcacgagatctgatggttttataaggggcttttccccttttgctcagcacttctccttcctgctgccgtgtgaagaaggacatatttccttccccttctgccatgattgtaagtttcctgaggcctccccagccatgctgaactgtgagtcaattaaacctcttttctttataaattacccagtattaggtatgtctttattagctgtgtgagaatggactaatacaggtatcaaagaatttgcggtcatcttttttaaaatcacaaaatttcaggagatttaattaataaagtgagactcaggtctaggcaggtaattagaggggcctccaagaaggaaacaaagactttgtctaacacactatggtctggagacagatctcctaggggccttgctcagctttttgcttacagcattgagctccagggattggctctgcttgccacagggtgatgtgccccatctctttatgttactgagggcagaagaagggtggatatctatagtttgcctgcatttcaggatccaagtcaagaaggagaagaaagaggaatggccctattgtgggagcctccatgatcgctactgcatttggcagtgatatatactcccttaacctttcctctgcaaagaaattgataatgatacttgcactagtaaatgtccacttctaaatgtctgtataaataaaacaagtatctaaactcattcttgccccataaaatgtctacactttaaaagtaaatcatgccaatctgctcatacaggcagaaactaaagagcctttaaatttgttttgcaaacaatcacatcaggatttgttctaatatactgatgcagtggacagatttatgatttttaggaagataggcacatattttgcagagagtaaaaatggaaattcagtgatagaaaatggaggtttgctccatgtaaggataggggctcatatgactcagtggaaaatagaggataatcgactctattatcctgcctttatgtggaattgcaataatgtccattcatattaaaaataaaattgaagactttcctaataatccagtcattcacaaataaatattgattgaatgccaaatatattccaggcaccagacactctcttaagcacttggatacagcagtgagcaacaaaaaaccttgccttccttggctttgaattccaatgcatagggaacaaaagcaaatgaatcagtaaaaattattacatgttatatggtgataaattataaaggaaaaaaatcagggaatgaatatagagggtcagggaaatggcttaaaattattaaaagcgtggccaagaggtcacgttgcaaagttcacatttgcccaaatagctaaatgaagcaagggagtgaaccaccacagccagctggaggaagagcattttgagaatacagaataagtgcaaaggccctggggtggtcggggagggtggtctgtgcaagagcatgacgaagtccatcgtggctgaggagtggtcagaagaacctgaccatgtgtgcctgttggttatttaaggattttggttttaaccaaagtgagctgggtggctgctggagggtgtgaaggaagagactcctaatctgagatggatctctgggatgaatggttgttggtgtttgagaagctattgcagtaatcgagtcaagaaatggtgctggcgtggccccgggtggcagtggtgggtgaaagcactgagagtgtgttctgcgaggagacttgccaagattgacccacagaccacatgtgggatattagggagcataacagtcaggtttctggcccagcccctgcaagtatagagtgccattgtttttagattgggaatgctgagaaaggaacaggtttagggttatgtttggtttgtaaagtttaagatgccattggatactgaaataaatgtatgaatctggagttcacagaaaaggtttcgattagattataatagagcaaaatcaacttccagagtagaagtgggagttttattttttatttatttattttattttttaccagaactgctatttttacaaactgaaagtcccttagaacatacactgaaaaaaaaatcccagttattctctgagtccttacatagaattgaagaccacctgcctgtttgtctttgcctgtttccttttcttctgttcttaactcctctccagctcctgaatagcaattttgtttctctctgcctcatgcaacagacttttctggatgattcgccccatcccccgtcatgccaagcctctgccccacttcatttctctttcagtgagtggagcctccgccgtctcccagacctattgttgcctggaccctctcaagcctaccccttcctctcctccctcccctcctttactccgtccctttccatggagccacactcggggcaagaccatctgctctggccttccgaggcttccgcactgctggcagatgctccccacgtcccctagaatggtttgtgatctttctctgtctggtcccaacatgcctttccagcctcctccctccccacgccagcagttaacccacgcatccatccaggagatttcccacacagactgcacataccgcacaggtgtgacctgctggtgatgatctgctttctctaaaatggactttcccttctgtctgcacttgctgatcaacaaaaagcctgctgggcctttaagacaggcctcaaaccacctctgctgtgaagcctgcccttcctcgtcaagaccccaaacgaggctcacctccccgtgaccgtgcagcgtgctgctggtcctgccaacggtgcccctgacggagctgtggttggtcctgtgtttacctcttcggcctttccacccctccagaggtccgcctcttgtctccaggtctttgtatctaactgaccagttggacactcaccaacctgaatgccatgtggtgttctggaaagcttcctctgtaatttccagttcagatcagttgttcatcctgtgcactccagtctcatcctgtgcttaattctaccacaacaaacaacgcagtattaaaattgtctgtgcagctttctctgcagtctgaaagacctcgaagagaacagacctgccttatttactgtgcgagtatccagctagagcctggagctcagtaaatatctgtgatttcactctttctctttctccttccatcccttcccctgtcctcctctccctttcttctttctttccttctttctttcagcacacatcagtacaattccacacaatggaaagagaagagtgaacaaggcaggacatttagaagggaaagtggaggagcaaagtgaggaaatcttatcagaaaaggggtgatcagcaatgtttaatgttgtcacaggcaagaaatatgcaggcaaaaaaatcctttacattctgtaactaggatgttgcatggagatttatataaagagtgttgggctgggcacagtggctcatgcctgtaatcccagccctctgggaggctgaggcgggcggatcacctgaggtcaggagttgtagacaagcctggtcaacatggtgaaaccccatctctaccaaaaatacaaaaattagctgggcactgtggcgggcgcatgtaatcccagcttctcgggaggctgaggtgagagaatcacttgaacctgggaggcagaggtttcagtgagccgagatggcgccattgcactccagcctgggcaacaagagcaaaactccatactccatctcaaaaaaaaaaaaaaaaaaaaaaaagaatgttaacacttcttgctcctaccgtcttactcatttcttccttcgtcactcattcattcagtaaacattggatttctatttcctgcctcctctaagattttctaggcacttggacctcaaagatgaagctattctcacacgcacagattgtcaggactttgaggctttatgggtgatgggcctttacacattgtactgtctccataaagcccctccttagcttccatttttttttcttttgagacagagttccactcttgttgcccaggctggagtgcaatgaatggcacagtctcggctcactgcaacctttgcctcctgggttcaagcgattctcccgcctcagcctcctgagtagctgggattacaggcacacaccaatacgcccagctaatttttgtatttttgtagacatggggtttcaccatgttggccaggctggtctcagactcctgacctcaggtaatccgcccgcctcagcctcccaaagtgctgggattacaggcatgagccactgtgcccagccaagcccctttttagtttctgtggggacccctcattcagccacagacttgccccttcaatggccacttcattcttccatgtgcgtttttccttgttctcaagttgtctcctcagcttgagtgtgaaaaacatttcatgctttttagtatcatccttaggataagtctcatatctgtgcactttcatattgatcaaaaaaatcacaagaggataactgaatggacaactataaaacctcctgtttctctatttcatgtcagacaaccctagctcccttagctttgcttccagctcctttttcctgatgctttaatcattgctgttcctctcttaatgtgcatcatgcacactatagttctctaaaatcaggccactttaagccatccacaggattttatggaatactaatcagtgtcatgttccactcaacatgtgatcggattttgagagcagtgaacagggtgtcctctgagggcctggggtaatacccccattctgaatcacaaaggccagccccatggggtcagagggttggcctggttagccttgtggagcctgtgttctccaaacagacatttaattactgtccccaatgagtaccctgatcacaatacttattgctccaatggggtctgtgggtggggattgcaaaggggaaggttgccctgcttagctcaaggggagcatctcctgagaaagctgattccgacagaagtgcagtcaactcagcaagcctcttccttctgtcctgttcctaaaaccatctgctcattgcaggaagcgactccattccgtcagccatactgatggcattaggttctcctaaaacatctgggttttccttgtgggagaaaatcctgcagtgaatttagatgttggtggacctctaagcaagggcctcattgagtataggaggggaaattataaatgtcaaattataagtgtgcaaattatacaagtgcacccctgcttggccttgcagggcaccactggccagctcccccctctccaatttttcttctgttgccgtgatggtgaatgttagttgtcaacttgattggattgaaggatgcctagatagctggtaatgtgtgatttctgggtgtgtcggtgagggtgctgccagaggagactgacgtttgagtcagtggactgggagaggaagacccatcctcagtgtgggtgggcaccatcccatcggctgccagtgcaggcagaacaaagcaggcagaagaaggtaagataagcttactcgctggttcttctggcttcttgctttatcctgtgctggatgcttctttcagcttctcctgcccttggacatcagactcccggttcctccgcctttggactctggcacttatgctagtggtttgccgggggctctccagcctctggccacagtctgaaggctgcattgtcggcttccctggttttgaggcttttggacttggactgagccactaccggcttctctcttccccagcttgcagatggcctatggtgggacttcacgtcgtgagcatgtgagacaattctccctaataagctccgtttcatatacacatacatcccacagatctgtccctctggagattcctgaccaatacggttgcccacccttctttgtctcttctttgccacgttcacttctacgtggcctcacggaacccacgtggccttgcctttctggaatcgcagtctcctccatgtggagatgcgtcacctgtagctgatggataatcacttggaaatgcagctgccccggacgggaaggggttgtgcatttctcatattgtttttggctagaccttgagaaattttgcttcctggacaacttagtcatattttatgaagatcctttgtcagtggctagaaaattggacatgtatgatatatggctggggaggactaatgggctcttccttcaacactctgtcaaagtggggccagtgcccatggtggaacgtgctttagtaagatgagagaaggtgttttcatgattaacaaggcatggcattcgtatttcaaagatcacatgacatatcaaaacagtctgctaccgtgtatttatttggtggcatggacatgggacatgtggtattttctcagggacccttcggccctggacctgtgctgtgcaggcatctgcctgtacacactgcagctgttaacctgtgcataacaaacagccaatgtaagatcagatttgaggctgggagtggtggcacacctctgtgtgtgtgcttacataacatacactcaatgtaagatcagatttgaggctgggagtggtggcacacctctatgtgtgtgcttacgtaacaaacactcagtgtaagatcaggtttgaggctgggagtcgtggcatacctctgtgtgtgtgcctacataacaaacactcagtgtaagattaggtttgaggctgggagtggtggcacacctctgtgtgtgtgcttacataacaaacactcagtgtaagatcaggtttgaggctgggagtggtggcacacgcctgcggtcccagctactccagaggctgaggtgggaggacgcttaagctcaggaggtcaaggctgcactgagccatgatttcaccactgcactccagcctgggtgatagagtgagactctgtctaaaaaacaaaaccaaaaaaacataagatcgaatttgactcgaccgtttgtccctctgacacgtaatctaagatgtcagaagtatttgtgtcaaagaaggcaagtgggagagaccgggcctgaggtgatgctgtgttccttctttgatgacatcattaacgaggagagggatggccaaaagaatccaaaatgaaaagtgtgctgataacagaaccaatcacaggcacaactagcctgggattccaggcctgccgaggctgctcactgcggagcctgtgtctgattctgtgtgaccagagccttggctgcaaataacgaccagcctttcctcatcacccaccagcaggcacccaccacagccctgtttgaggtcctttgaactcacagttttagaaaaggtcagtagtcaggtgatatggtttagctgtgtgcccacccaaatctcatctgaattgtagctcccataattcccaagtgtcctgggagggacacagtgggaggtaatcgattcatgagggtgggtctttcctgtgctgttctcatgagaatgaatagggcttacaagagctgatggtttataaaggggagttcccctgcacttgctgtctttgtctgctgccgtggaagacgtgcctttacttctcctttgccttctgccgtgattgtgaggcctccccagccatgtggaactgtgagtccattaaacctctttcctttataaattacccagtcttgggtatgtctttattagcagcatgagaacagactgatgcatcaggataagtccacattgcaggctcttcagggcatggccccgactcgctttcccatctcacttttggcctgtccctcatgtgtaccctgggcccagctgtgacctatggaacggtataactcccctgaatacactgtgctcccacagattatgtgcctgcccactccatctccacagcccccatggagaggagagaaaggggtggcagactctgcctatgcgcccttgtttcttactcagagataaaagttcattcagaaaacatcttgagttcccccaggctccgttacttccttctttgctcccatagcattacctggtgaaaagtgcttctgttgcaaaacttatgttcatgtgtctgcctcacttctccatgaggggctcagtttcttaagaggaggaacagaaaggctaggtctggtctctgcatctccaaccgctaggccaggcgttatatccttggtgcgtgtttatagaatgtgatggtagacatggagtgtggtggggtgagcagagcagatgtgattgacattctggtgaaaaggctgagcaaacacaggacccactgctctgtccctgcactgggctgcgtgctggagattcagtggccactcatgctgctgctgtgttcttgtggaggtaagaggcagtgggtagaggagcaacaggtgatatgtgaatgctcctgactttgtaggaaatgggaaaggggctgatgggtgggggtgcacgtgggtgaaggaggtctgggaaggtgtctctcctgagaaggcagcagctggtctgggaatgaagggtgcgatggagctcactgacaacccaggcacaggtgagagcaggtgcacagtccctggagagaaaagaggctgaaaggctggaggaaaagttgagacccatgtggggagggacggatgaaggttcagatcaggggcctccggaagtgagggaaggagcaacgcactgacgctgagtgctttcaagcaggggagtgcagagaatggatttcaccttgaaaagtgaatgtggaccataacaagtgttggcgaggatatggagagaagggaaccctcacacagtgttagagggaatgtgagttttacagccatatggaaaatagtgtggaggttccttaaaaaaaaaatccaaaatagaattactggatgatccagcaatcccacttctgggtttagaaccaaaggaactgaaatcagcttgtcaaagagacatctgcactcccatgctcactgcagcactgttctggatggccaggatatggaaacattccctgtgctcatccacagatgaatggataagaaacgtgtggtgtatgtacacaatggaatactatgcagccttaaaaaagcaggagagtctgtcaattgtgacaacatgaatgaacctggaggacattgtgttaaatgaaataagccaggcacagaaagacaaataccacattatgtcacttgtgtagaatcttaaaaagtcaaaattacagaggcagagactagctcagggatggttgggggtgggttggggagatgttggtacaaggatataaaatttcattggacaggaggcataagtttttgagatcaattgcacaacatggtgactatatttaataatgtaaagtatgtttcagaaattgctgagagtagattttaaatatttgtaccacacacccacaaacataagtctgtgaggtgatatatatgttaactagcttgatataagcattccatatgtgtatatgtatatcaaaacatcataatggaccccatgaatatatgtaattattatttgtcagttttaaacattttttttaaatgaacatggaggttggggaaccttaccagggttcttttggtctccgccttgcctggggcccagaagtgctggtgaggggttgctccctactctggagctctggatgctgatcagagaccctccatgcctggtgacatctcagactcagtgaacagcctcaggggcccttcacaaaactgggctgtcagggccacctggagctcagagtggtaatttggttccatttgaacttcaattttcgttgctttgaaatctcattcagttgaatttaataacaaataaataattcatggggactggacaatgaaaggaaaatttaaaaatgtgttcacccaaatatataaaggggcaccttgtccctcagccctgttctctaccttcttttctcagctggcttctgggcagattcatggcgccaaaggatgatgcgttaactctctcagggtgctgagggttctctcatcatgagacttctgtgggttagggactgggcaagaggtgagcaagtatcccacctctggcaggccagcctctcagccaccaatttgctaagtggcccaccggtcatctctgagccttgtttccttgcttgtaaaatgcagaaatctttagtaaaccaattgatgtaggcaaatgtcatgaatggatacacagtcatctcagggaatttacatggtgttaaagtatcactccagggatcatctgctggttgcaaggggagaaatgtgactttatcctggagaacaccgatgctctccaccttatcaattcctgcatccctaacactgggacaagcagatatccttccatgccccatgcggtgcctagcatcacctgtgaggtaatgccacaaacttgtgagctgaacttaatcaagctcttaggtctaactttcagtgcgtaacaaacacaggctgcagagcatccagctaatgcacaccaggaggaaacagccagacaaatccagaaggtggaaacgtggaggcaacaactcacccattccttccagcaagccagcaatgtgtggtgggctggggagccactggggcggacaggttctaagttgaaatatacgttaccaccaaccaagggcaattcctgggcctcggctaaatccttacctatacaaaccagctataccagtcactttagagtaattggggaagttattacatgagattagaaaattgtattcattttttaagtgtgaaaatgttctttttcctttttaaaaaagcttctgttttaggttcagtggcacatatgcaggtttgttacatagagaagcttatgtcatgggggtttgttgaacagactcttcttaattatacaggaaaacgtctagagcttgtggtctctcttctttagcgttgcttactgagattttttaaaaagatgcatcctgaatgatttcgaggcataatgttttggtacctgtatgcaattgaaataatttttaaaatagatatggagtaaatatgaaaactaacaattttcaaaattttaatgaggagcatatgaaaattatactctagtatgctgttacttttcttttctttttttcttttttcttttttcttttttgagacagtcttgctctgttgcccaggctggactgctgtggcacaatctcagttcattgcaacctctgcctcccaggttcaagtgattttcctgtctcagcctcctgagtagctgggattatggggcacccaccaccatgcccagctaatttttgtatttttagtagagatagggtttcaccatgttggccaggctggtctggaactcctgacctcaagtgatccacccgcctcagcctcccaaaatgctgggattacaggcgtgagccaccgcgcctggccgctgttaattttctaatctttaaaaataataatagtttttttaaaaagctgctcacaaatattttattgatgatgtgtgcatttttttttcctctggtaggacataattctccctgagaaggggaaagacagtaagaattttgtgagttgcataatagtccattgattaccctttgtcccccagtggagggcactaaacccctgaagaagcaggcccctgtgtgggcgtgttatgattgtagaacaaggagaggggaccctccagtactcagtgtctttagtgggtggggcgggggcttcaaggcagtagcctcagatacctgcggggcccatgcagggaaccctaattggggtgcagggtgggggagcaacagaatgcaaaatagctcttagtaccttacctaaatattggttgctagattttttcattgactggaagctttcatttggctctggatagaagtgtgggcagtcacacaagtcaaggtaagaggggtggaaactggtttttgctggtgcttcctaacatttgtcaactgtggctttcaggctaccaatgggtggggagttttgtgcgagaaaatggaccacatttgcatcctggtgttctccaaatgatgttaaatgcagaaacattcaatgcaatgagtttgttcaattccatccaactaaaaattgtgtttgtgctattagtgcctaccctctgatcagtcttgtactaggtaggaaacatggtgcttaccctttactaaggagttgtgttacatgaaacagaaaacactatgactgaatcaaaaagaagcatcactctgcttgggtagtcagggaagaatcttgatttcccctggaatctggtacttacctcgcggtgaatatacaataacagccagagttttaaaatagacaagaaggacagaaatcagagagaaaaacacagacacatcagaccccttatcataaggtacaaacaatagagcagaagggagaccacaaacttccattctttatgggatgagcgagaaaggggatggaggctttggcaatgttgaatgggttttccacaggaacagccagccccaactgatgtgtagtgatttcctaggaagtttgcaaacctcatcccaccaagaggaaatgggtcgggagttctccatcatctggaggtcacagagcagacagaccatggcccaggacaagatctagaagttgttattttattcaaagtcagaaaaccttccagggtctggggatcagtgtctggatagaagagaaaatacaagagaaagcaagaggttaatgtgggctgaaggcttagaatgagcagttttaggataaaggatagttaggaaaggatgggggatggagaggagggtgcatgtaaggcaggacaaaccaaagagaaagacctgaatgtatctgctgtgtctgtgggacatagggaggttctgttcattctgaatgggggcttcgagctcaagcctaaaaatccatcctttcaaataggtacagaaagaagggctttgacaagtaccatgggctgtgcttgattgaaaggacagacacattcagttgttgttatttgtgattattgtcagctccatcattgatggcactgtgcattttttgaagtaggtctctcccatcaaactgccaggattccagtgatcagagagcaggtcttcagtagcacaggctggattgggtggtgcccactcccggcttgaccacttagctctgtggtgccttggtatcctcatctgtaacgtggggataataatggtgtctgtctcataagaatgttttgagaaacaaatgagaaaacccaagtcaagctcttctagaagtgcatggcagatagtaaacagtcaatcaacattatcagtcctatcaccggtgtgggtactgttgagatacctgtgagagtaaatcatgatttatgccaatggttaatggaaaatatttattttagttattttcttatctgggtagtgccagatgggataataaaaatgaaaacaggcagggtttcgtgtgtgtgtgtgtgtgtgtgtgtgtgtgtgtgtgtgttgctttgtttgcaagcatgatttagttgaaattagatgtctcttctgatctataatctctttgtcttcagactgaaacctgaaatcccatctgaatatggctgaagcaaatctgcacacagtgtcttgatgggaggatatgactaactcttagattggaattgtgttggtgcgtaggcaggttctattattaggggtaatgttaccacattattaaaatatttttaggcataagacaggattctttccttcacagataaatggtgaaacacacatattcctaatttttaaattttgatcaaaattttattaaggccaaaatgggcagagactgggtaacagaagccatattttccaatttgccctcctttactctcccagattctccttgcatgttggctggagtggatcacgaagggtaggaagctgagaaaggtggaataattggaatgttctgcaactctgaagccaaacaaacttaggttttggatgacgtggacagtggatatcatatcacctgttatggtgaaaccatcaccaatacttactttacaattcccatcacacaccccagtgactttctgtgaaagagagatcagatatctactgtatttagatcaactattacattatcaacagtggaggaataaggaaatctaggatgctgtttagtagcaaggaatgcatcaacaatagataaaaggtggccaggcatggtggctcacacctttaatcccagtattttgggaggctgaggcgggtggatcatttgaggccagaagttcgagaccagcctggccaacatggtgaaaccctgtctctactaaaaatacaaatattagccaggcgtggtggcacatgcctgtaaccccagctcctcaggaggctgagggaggagacttgcttgaatccaggaggcagaggttgcagtgaactgagattatgctgctgcactcctgcttgggcaacagagtgagactccatctcaaaaaaagaaaaaaaaaaggaatctctcagtaggtactaaataaaacagggaaaaaaacataactaaacataactacaaactttcttttctttcttttttttgtgataagaacacttaacatgagatctaccctctccataaatgtttaagtcttgttaactgaaagcacaataggatacagcaaatatctagaacttatttcattttgcacaactgaaactttgtacccatggaacgcctcccatttccccttctcccaagcccctggcaagcacctctctactctctgtacaagtctgcctgctttaggaagtggaaccatgtagggtttatccttctgtggttggttcatttcacttaccataacatcctgtaggttcagtcatgtttttgcatatggcaggattttctgctgtattaaggctaaataatacttgatggtatatatgtgccacattttctttatccattcgtctgtcaatgagcatttagatggtttccacatttgggctattatgaataatgctgcaatgaacatggaagtgcagatagttctttgaggtcctgattttaattattttggatacgtacctggaaatgagattgttggattatatggtggttctatttttagtgttttcaggaagcctcatactgtattccaaagtggctataccattttgcattccccccaacaatgtacaaggattctgatttctacacatccttgtcaacatttgttttcctacatatatatatatatatatacacacacacacacacacatacacacaacacacacacctacatacatatagatatataatagcaaccctcataggtgtgaggtgatacctctttgtggttttgatttcatttccctgatggttaatgatgttgaacatctttttatgtgcctgttggccatttgcatgttttagttgaagaaatgccttttcaagatttttgcttttgtttcttgtgcttttggtgtcatatccaagaagtcattgcctgggccaatgtcatgaagcatttcccccatgccttcttttgggagttttacaatgtcaggtattatgtttaagtctttaatacattttgagtcgttttttatgtacagcataagataagagttcagttctcttgtatggatatccagttttcccagcaccatttttggaagagactgttattttcccatcatgtattattggcactaactataatggtgaaaagttaaacgcttttcctttaagatcaggaacaagacaaggacgcccacagtcactgcttctattcagcatagtagtggaagtccttgccagggcaattaggcaagagaaagaaactaaaggcatctaaatgagaaaaagataaaattatttctatttgcggatgacatgatcttatgtgtagacaacccaaactttcttatcttcacagaatattttgcaagagttgagctcctagaaaatgagcttagatcatttctcccctctggccagtaacaagatgctcctacactgagcttcatttagcacagccctggacacaccaccaggcactcagcaaacatcagacaatttccagttcaatggaaaattctcagttatccatggcagaatcatggccctgtcatgcactggctgagtttgcttgaggaagctgcttaagctttctgactcttggttttgttatctgcaaaaggggaatagcagtgtctataccacagggataatatgaaggctaaatgagatcctgtaaagcaatctttccaagtcctgagcttgacacaataataaaaactaacctttatttaattattgagggtggaggaaggaggataaagaacagaaccaaagaacagaagttatttcccagtgaacttaaacaattcatgagttttctcatcttaagcagggaggccttaactgcattgtctcatgcctttaaccagtgagagtcagagagagctaaggcacatccaactccgttgctcaactcccaggcacccagcaacaggtatagagcattgggagctgcactctccatactgatgttataattaatcttccacctcagtcaaccgatcatagagttccacttttggaagtgttccaacctgcacccaggaggcttctgcagtcttttttgctgccagaatgtcctccctgatttacacctgacttcggcaacatctgagcattcatatctgtgctacatgctggctgtagccatgggtctcattctaaaacatccttgccttcaaatacaggcatgaggcaggagtggaggaaggagaggtaagaaactattcatcggccgcctcatgggcatgctgacggcaagagttatgaggtgtaaacctgggttcacatcttgttttcttctccaggtgagggtacttcatagagctcagaagaaactcaaggaccagctctctcgggctgcccctgtaatatggcccactgagggcaggttcctggctgcccttggaacagtgctgcagtcatcaggtggtgtgaaagacaaatgcctttgtgccctcaaaggcaaccagtatatatgggaggtgctgtccccccttctgccactcatcagctcatggtaaacagaggccacttaggcaccactcaaggcattgaccagtctgagtcctaattatagggtcctacttatagccattatgaacctcaaagccaaacaagatgaattttgtcaaaggactcctcctggctttagttgaacagaatcatcagactaggaagccattagtgaccttcgtgagtttccagatcttcattctcatggctcttatcagagatttgctctgaggtgatagtgttatagggccctgatgcaaaaagcccagtgcagattggcttacctgctgctgcatcttgattgtccatgggtggggtctactcctgaggtcttgggattgaaaaagttcacacggactgtaaatcctgccattgctactgatgacacttgtacttgttgcggtgtgtccattgtagtgggaagagctctgctcttagagtgttatacagcctatagggtttggattcttcacatttggttggttgactttgagtctcagcactttcaattgtaaggtggggacagtacaaacttacagaagttattgtgaatacacaaccatccaagtaattacacctgcagagctgactagtttactttcttgcttgctgtctggtaaaactcttgccaatcatagacaaacgatcaatgcataaggtaacctcatttgagagttcaagttctgaacagaagaaaaggatctcattcctgttatgaacagcttagttataaagtcaaatgtaaaatcaaatatgtgtttctgtggcaaatggttaaattcttaccttttacaaaacattcagtagtcacaaggtctttacacacccactgcttatccatcatatttatatatggtgtgcctgttaggtaagacatacacactttggttagttacttgaatagatcataaaattaagtctaggactatgttttctgctttatttaaattttctcatccaaggaaaaatttcataaagagtggttaaatgaatgaatgaatggacatttactgtcttgaataaaacctttttatataacttagcttgttttgcaaaagaataaaacactgggttcaaactctttatttttcattgatctttagaaatcagggtccctcttttgaatacaccccttgctcaaggaaaggaaccatttatgttctggccttgattactgcacaatggcttttactacatttgatttgcagcagttcatttgtgattaaattttctaattctcccagaaagtcattgaacaagcaaacagtttactttccccaataaaacaaaacctaaagtatttggtctttaataaatgttcaaaaattattttctcagtgtgtgttcgagatataaatatcccttcatctcaaccgtcttttaaatatttgaccaatctacctttacagagtagttgtttctccttatgtcatttctgatctatctttcttgaatttttctttgcttagtttttaatcaagccaaatgtttgtttaatcagatacctcaattagtcaagacctgtctcttttatcagaaggtgaatttagagaacaattctaaaacatagggtaatacaatttttttaaaagaaaaataaccaaattctaagctcagcttggtcccagggcaaattcactcctcattcttaattcttcttctccatttctggtcacgggaggggcacccccaaaatgctgaccctaggactccccaagatcctccagcatccaaaaggcctctcttctccagtctttactttctatgggaacaggttgaaacccctgggaatgaatacattctcaactaaaaatacaaattaaaagaatttcttgcttagactatcagaaacttgatctagtgcacatatttcccaagcatttcatttactagatctgattaagacactctgttattgtatcatttaaatttttaaattttattatttaaattttaaatacaagttttaaaggatggttacaaattagtaactcaaaataattgagtggagagatcaaggtacaagacactctgcctttaccttcaaagtctgagcaaatatgattttatatcgttttaatcagagattcttttaaagaccaagttactgcagtcctgtcttgttcttctcctattttatactgatgtgctcagtaccttggtgtctttgtctgtcttttagggggaagggaacccacgttttggactagagtagcacagatgccattcttacctcactgtaggtttctttaaagaatgtttagtcctgacaatgcgatgcagatttctttctctccccactctatcttctcttgcagagctttatccctttttcattgttcagcatgactgggaacctgccagctcgccacaatgaaacataatgtttttgcaaagtgtgtgtcaaatgtcgtgagcttagaagagattcatcgtagagactgctgcttaatgagtgtaaattaactgatcatttgctaaatctgatgtgcccagtggtgtgggtgggagaatgctggataggatgtaggagatgcaggtgagcagacgggtagcagagacacataccgtgtttctgagcgaggactgtagcatggccagaaggctgttctgatgtagagagggattttccgctcacggtaggacccagtaccatgagactgaggactgaaacacaaagttaacacagatctcccgaacagtctgctttagggctggagcctgctgggatcagtcctcttgagaagaactacaatctggttgagattgaacttgccaaagacaatgagactaaacaagagatgcctgctggtaaacatcaggggtgttgtgtggaagctgagggaggaagaaaacacaaaagctgtgcatgatgataaggctagtgggcctagtgttaccagtaccacagatctacagctcctcctagaggcagggcacattcagaataagcaacagggagctgcatgtcatgtagtcaagcaactgtatatttcttcttcattgatttctgggacatacatatgaaatatcttcagcttcatatctgagatggcaggaacatgacaacatattagcttttaggtagacacccgtaggtcttaggatgtggtggaaaattgggtgtcattttttccagataatcactggcatttttataaaacatgaagcccttcctaaagtctgtgcttcccagatagtagtgaggagaaataggcttgtggagaccataagggtttattttggagtgggtcttgtgaatttgacagtttaatagtcacgtggacgcacactgttgtttgcaggaggggccatgaacccctgccctgaatgaaagggaaatacttatgtccgtggtaaccagggccagtggcagccaggaagccaagacctggcctccgctgccactgctcatacaaaccaaacgtgtacatcacgtatgggatataggagaagcacatctgaagggctatggcagaagtggaaagaaggcaaaactcttccacacaggcaacccgtgctttccagacaaatctcacaacatcaaactagaagtattcatgccaccccctacccctgccaactagaactggctgtctgtgtcaggtcgtcatcttatcttagaacacatccattgatacatacactgtttcttcttccctattacctctgattctgcttctctaaaataaaagctgaccgactggttggaataataatacatataccacctggcattttacagttttacatcatctcaggtgatacaaccaggctatgatgcagtcatgtcaccatactctttaccagatgagatgcaaactcagaaatattaggaaatgtagctgtgatggattgggctataatcaacttgtgatgtgggagtttctcagaatctctttccctatatacatatggttccgagctagagctggccacagtgaagccatgagacttgggaggtgaatgaaggaggggccattatgctctggaggttttcatcgtgtaactgaacacaggtccggatgctcaccgcctgcagaatccagttaacaagaatgagttctggtagaaagaaagtgactttattcactcaaactagtaaagaacaagtggccgggttcccatccaaagcaaccacttcaatttggcagagaggaagacaggggtttaaaaaaggaaatcttgacgtgaaaagcttgcaagaattgtgctgagtacaacgtctgtgtaccttgttctggtggctatcttgggtcccagtttacctggatctcgggctggtgtcatctcaacaatggtgaggctgttgactcgccaccttgaagtcatctctggaactttgcaggtgggtctccagacttggttcatgtgtctcaagattacccccaggagcttctaaaaagggacataattagatgctagcatacaggtagatgaatgtgaagggagtatagatggtgagaaagggagggatgtggagttcattttaagacaaagagggaaaggcttctgcaatttgcttcaaggttatatcttgaaacgcacgagaaataagtaaaaagtttaaaatgcattttgcagttaaactgcccagttacaattggtcagaagtggtgagagacacagtggagctgacacagggtgcaagtttgtcttcactcttccttacccctgtctttatttcccgatttccagccctgctgacttgcagtgagtccagggccaccatgcgatgctgtaccccactcgacagacctttacttccatagcacctcacatcattcctgtaaaaggttgttactctataatattccaaatattgagagtttcactctcaagtttgaactctgactgacacattacctgtggtctccaggtgggaggtgatgtgttttttacactttataatttttttttatttttatcactcactatacttgactgtgttatgatttctatattcgtcattcttcctgcatcattttctctcttctttttttttttttctgagacagagtctcgctctgtagcccaggctggagtgcagtggtgtgatctcagctcactgcaagctccccctcatgggttcacgccattctcctgcctcagcctcctgagtagctgggaatacaggtgtccgccaccatgcccagctaattttttttatttttagtagagacggggtttcaccatgttagccaggatggtcttgatctcttgacctcgtgatccgcccgcctcagcctcccaaagtgctgggataacaggcttgagccaccgcgcccagccatctatgttcatttcaaaggggtcttccttaatgatagtgcccttgaaccaaaaattaaagagttgattaaagtagtagaaaatggtcatctatacaagtttcatgatttataagaactatggaaattgctccttagaaaatagctttctaaacatgaaaatacagttgattagaaacagtacacatgaggaactctggtttcatgcaaagttgaaggaaattcttgtgaaattaaaaatgcacccagaacagttgatgaagtctagtccaatgaaagggttttcaactgtttgatttccatcttgtcaaagaatcaacttttggttttggtgaatgaagtggtttggctgtttccccacccagatctcactttgaattgtaataatccccacaggtcaagggcgggaccaggtggagacaattgaatcctggggctggtttcccccatgctgttcttgtggcaatgagttctcaggagatctgatggttttctaaggggctttcccctttgctcgactctcatgccctctcttgctgctctgtgaaggggcgccttcctccataactgtaagtttcctgagtccctcccagccatgtggaactgtgagtctgttaaacccgttttctttataaattaaccagtctcaggtatttcttcatagcagcatgagaacggactaatccggtaatattctccactgtttttctattctctacgttatttacttctgctctattatttattgtttccttccctctgcttgctttgggtttagcttgctcttcttttgctagtttcgtaaggcagagtgtaggttgtggattcgagatctttcttccttcttaatataaatgtttacggctataattttccttccaattactgtttttattgcattccctaagttctggtatgttgtgtggtatttttgtttttattcagctcaaagtatttttgtgtttcccttgtggtttcctccttaatactttggtaatttatcagggtgtttaatttccaaatattcttgtgtattttccagttttccatctgttactgatttctaaattcattctgttgtgatcagaaaaagacactttgtgtgagttgatttcaaccttttaaaaattatgaagacttgttttgtgacctcacatacagtccattttagagaatgtttcaggtgcactggggggacatgtgtattctgctgggcttggcagagtctaataatccctaatatacctcgcttctaatgtaggtgttcccaccagagcatgccagtgtcatgtccacaataacaaacaaaaattcttttttttctttttctaaagccatattgtagattcccagttcaactataatatatattattttagctatctatttaaagtgtcacatcatcctagggacctttcaacggactgactacatttctcacaattatagtaattactgaaaataaacacatgagactattctcttcaactaaaatatcatcttattttacatttagtacaattgagaaatttgcatgtaaagctaaggaaggacacagctttagaaacaatggactcatttctctccagacctatgtgaaagttggtttgacagtaattaccttatgggagcccaaagttatgaaataaggatgaggaatgattgttcccatcacagacggatcaccacatcatcccctgtgcatttgcatgttgtgtactgatcagaggtggcgtggtgtggaggggcggcagtggtgacgtggaaatgtaaagaatttcgtgtactgaggatccagttaaaaatcacactggaaagagaaccacatatagtcaaggaaagaagaagtggcctacaaacctgtgatatgatcttgaaatgacttattttaacaagcatacctcccatctattatataaaataaaccgaagttactagaaagagatgggggttaaattccctatcacttactagctgagtgactttgagcctgtttcctagtctctgtgagcttgtgtttcttcatgtgggtaatagaagtcataataatactcactttagcaatttgctgtaataattggcaacaatatcttgaagcacagattataatgtccagtatgtaatagccctcttgtatgtcgctgtattctttctactgtccatagttctttaggttattagactgacttatgaactttgagcgctggtcatcagacctacttcacatggagcctcgagacccctccctcgaattatcagacccttccccctctggccatcatcctcctccctctgatcatcactgtgcgccctttgaccatcaccctcttccctctggcatcagactctcctccctctgcccatcctcctcctccctctgaccatcaggcccgccttacttcctcataccagcagccgtggagtggatcttcaacaagcagccaacagcagccagggacagatcctcgggcactgtttttctgtccgaaaaatcagaatcgtatcaaagggtcggacacctggactggcaagacacattggggttatttataacaggggaaaatgaggtctccagggaaacaaaccataataaagaatatgaactcccgcagaccgaattgccttcaacgatcctcaaagacttttgtgtttgaccaatatcaattaattacatcagtaaataactgcctgagccttgtacttctgtcctcccaagatccagaatgacttctgctttcaaaatgaatttcagggctttctttgaagcagtcttgtaaagttgttatatttagtttaaattcaattaaagctcaatctgaaagctctttctgaagcatttgttccacatttacatgaaggtatttgctcttaaaattgttaggggtatagctcatttctagtaataataagtggtatttcataaaccaggatacatgatcatttacttcctgatagcttgcttctcccagatctaattctattcttccttgagggctgttggtgccagtgccagggctgcaaacatcagggttagactggagagtgacccgtgtgctccttcacccctgggtggggcctctgtgcttatcagtaggctagcaccaggtgcaggagacagatgtgccgcctgctcacagggcttacctgggacaaatgtgccgctcgctcacggggcttacctggggacagttgtgctgcccgctcgtggggcttacctggggacactcactatgattacctgggacaaatgtgccgctcgctcacggggcttacctggggacagttgtgctgcccgctcgtggggcttacctggggacactcactatgattacctgggacagatgtgccacccgctcactatgattacatgggacagacatgctgcccatgccggggcttacctgggacagacgtgccacccactcactatgattacctgggacagacatgctgcccactcactatgattccatggggacagacatgccgcccacgcacggggcttacctgggatagatgtgccacccactcactatgattacctggggacagatgtgctgtctgctcacagggcttacctgggaatgaagttccactcctccacttgcttagttcttgtttatttgtctctcccaccatttcaagtctttgctatcatcatgaagaaatatgcagggtgctggctgtgcagtgatgagctgggagaaaatgatctgtgacagagctggtagttaaggaagaatcccttggctgaagcagagtgtaagggatgagaagccaaatgggtggagagcgggagcaggggaggagggtgagagcatgagagggacactgcatctccagaggctggagaggggcaggggtgcagcttgtcatgggacatgtaagagggccagggactgatgcagagagggacaggaagcagcctgcaccggcactgtgggagcaggcagatgggaacgtggacagggagttagtgttttctcctaaatgccatggaagacattgatgtattttcaacagtgcagatagaaagcagtaaatggtttcaaaaatatcccaaacaatacaatatatagaatttcctgatggatttgacttgcaaacagagtggaagaaagaagtatgatggcatctatgctttgtgctttttgagcaattggttgaatatggacaccattttctgtcactgagaagactcagggaagggcgggaggatgggggtaagtgtgcagggccggtgaaactgggagatccgtgagatgcccaagtggcaacgtcagctctgaggaaatgacactcagagacatggcctggactcgaaataaaatgtgggagtagttagcacacagattatgttccgaacctggaaatgaatgaccacacctaggaagaaaaagcaggaaaagagaggagagggcccttagagatcccaacagagggggctgaggtgtgtgtgtgtggtgagttggaggacagccagaagaaaagatgacgttccaacagctgagatgcagtcagggcgcagcccattggtatgcagcgtggaggtctttggagacatcactaggaaccgtttactaaaatgtcactaggagcagtgcctgtagaaaccagatcagggcacacgaaagggtaaatgggagacgagggagacatgacactctgctgtgtggactcagaaacctttctgcaaagagaagccaggaacacagcaggatgcaaactaagacgtgaaaactcattcttcgaagtcctttcagagtcctacctgcttctgtttatataccgcctacatttctgaaaattctagtgtaaaacaaacatgtatatattaaattacgttccttttacttttgttaaataaaaagtagtcgcattagagaagagcaaagctaagaaacataatgaaatgatgtgtaaggatcctaacatgaccactaaagagcaatgcacctgagtgtgaacgcatcaaacgcttccaggcctggcagtcaatccatgtgccatggcctcttacaaggaagtcatcgttctaacaccccatcggtagggcacaggctttggttattttatcagtgcacaaaaatgaattcacactgttactggctttcttctgctggtgcacattaggtgtgatggctccttgggcttacggatgacccctgtggctagaggcgagggtgaagataatgggttcacattgcacagattaaagcagagactctattgtgttcagaagaacctagagttaatgggccacaaacagatcatcttctggcctccctagcagagccctcggttgcctcctgacacagtccatttccactttgacacaagtgtttgccagctttgtggtacctgattattagggtcctcttagttctgtgattgctccaggaattcggtaaaaattgtcatctggaagaaccaaattgcagttcttaactgggtagaattcaggctcttcaattcttgattccattcattacgtgctcactgtaagaagtggtacctccttgggatattgaatcagaaaggtattagagaaagggctattcatggtgtagggatctttggacttgaaggtgaaatttcaaacatcttcaatattcattttggttctgggagaggtaggaaaactgtctagaaatggtccatttataatcatatatgtgaatagaacttagcattttggttggttggttggttaaatgtgtgattgtgaaatagggctatgatgagttgacataaggggaaatcgacctttaagtagggtgaccatataattttttatccaaatggggtcatgagagagggaagagtggtgctattaacattcacattgagacagatgaaaacattcacgtccagacagggaaacctggatgtgctgtcatcttatgagggcttgtcatttgctaggaacaatttggtggtcgtttttccttacacaacaaggagagaccaggagcctgccctcttggtagatcagctaaacatgtccacaggattttgcttccaagatgaacatgggtgtagctttcaggagtgtccatcgagcatcacgattcgaaacctgaattttcaggggcttctctgtcttgtcaccttcctttgctgcatgcttcagtctctgcttgaatttgcacctggaaatggggttgaaatacatttggtgcagaacgatagcatttcaaacctgtctaaacagtttgcagacattaaaaaggatttgtatgccaagaaggaggcccctagctcatggggccagccccagtttgccttccgaatatactcattttgctgccgttaaagactttctgtgtaatttgagtcaaaatatccctattttctagttataccgattttcttcacttctaaaccccaagccaccataacacttttttcaaagtctgttttgctcttcccaccccttccagctccttgggggatttcaagatgggattgtggagcatagttaaatccatcgtaattacattcagtcagctgtatcccctcttcttctttgcctttgggatttcactactttaaaaaagtattctctgttgctgaacaattaaacataacgctaaccttgcagtcagattagccataatgaatatggtgtgggcatttgatactaagttacgtcattttaagcaattaaattaatatctcaaagtcaaaaagctaattccaatgattgctgtagacattttaagaaaatattttccaagagaaaagggatatcaaaatataaccatttttcttttgccaagaatacattgcatttgttttaggtacagataagaggcattttaggtatagattaaaatctgtggtgaggaaatgtagtcaagaaaagggctttacttgcactggagaagacttcccctcatgcacggccctcactaacttggagctgagctgcttgctgtacacgagctgtgcatccaagtgagcctctgtagtccagcccaggactgctatctgctgttgcctccggctttctggtcatgctgggggagttggggtaaacaggagcagcatctcacacacacacacacacacacacacacacacacacagacacacacacacacacagacacacacacacacacacacacacaaaacagctctttctgaggttgggaaggaatcattctttccaatggcatcgttgcccagcgttggccagactgtgatctgtttctgtccaagaatgaagacagctttccctttctaaagctgttctcagctgttccctcatttcacaagctgctttccagctctgatgtctgtggttgctgtagcagcaggctaagccacacctgacccacagaaggacatgaggttggttctacctcacagagagaagctgaaatctttgttcctattaacacaaagataaggggctcggaagtgtgcctgagcgaatgggactgacagtagcaatgacggtggaagaaagcccaagaacgtctccacagagggatgcctggcaacacaggagcaggcccacatggccagcatctctgaggtttaccttacccgcaacaggcacagctggcctctctgccccatgcatgacttgccacatccctgaaatacgaattgcatgaattttatgctggaacaagctgcagagtgatcagtcacatttgcagccctgtggactatggctattggaccgtacaattaaaattaagtttgacattaaatctaaaacaaaattttttgaaaataaaaaggctagacatggtggctcacatctgtaatcccagcacttggggcagctgagatgggagggtcacttgagcccaggaattcgagactgggcaacatagtgagactgtctatttttctttttttgagacggagtctcgccctatcacccaggctggagtgcagtggtacgatctcagctcactgcaagctccgcctcctgggttcacgccattctcctgcctcagcctcccgagtagctgggactacaggcgcccgccaccgcgcctggctaattttttgtatttttagtagagacggggtttcaccatggtctggatctcctgacctcgtgatccacccgcctcggcctcccaaagtgctgggattacaggcgtgagacaccgtgcccagcccaagactatttttaaaaaatacatttacaaaataagatacatttaaaagtaagttgtctcatctgacggcagccttgcctgggacactgctccaaaggcaatcttagcagggactcaaatctgattgttactgctgggtcttctccctgaccctgggaggtataactacagaatcattcatgcagcatttgcaacttaccaaagggtaactttccacagttcccagcgttagcttagcaaccagagctgcagaatatgccgtcctgggcagaaaagggaatggtgagtactgtcagttgagctttgcatcttctctaccttgttgaggacataacatctccatcagagattcttacaaacccaccaccccccgacacacccccaagaagaaaagcctgggaagttctttctacccacatgccatctttagaagttctccaactttatggtagaggtcatcccgtcctggaaatgtcagagaggaagattatagaagctggtcaggaacttaatgaacatttcctgcaatacactcattgtggctagtgtcaccaactttaacaagtgacattaacaagaggcttatctagctagcctgagtcagttttgtgcctcggtgtgaaagctatttctagtaccattttgcttatagccaggaatagttcatatcaaaactgtggaccagagttcatttttagaggacagagctgctaagcagaaagcgacagggggcccaacctcaccctcctagctccttccctgttgacttaaccttttgaaaacatagacatgggccaggcacggtggcaaacacctgtaatgccagcactttggcaggctgagataggcggattgcttcagcccaggcgtttgagaccagcctagccaacatggtgaaaccctgtctctactaaaaataaaaaattagcggccgggcacagtggcttacgcctgtaatcccagcactttgggaggctgaggcaggtggatcacgaggtcaggagattgagaccatcctggctaacacagtgaaaccctgtctctgctaaaaagacaaaacaattagccaggcgtggtggtgggcacctgtagtcccagctactagggaggctgaggcaggagaatggcacaaacccaggaggcagagcttgcagtgagctgagattgtgccactgcactccagcctgggtgacagagcgagactctgtctcaaaaaaaaaaaaagaaaaagaaaaaaattagctgggcatggtgacacacgcctgtaatcccagttactcaggaggcggaggctggagaattgcttgagcctgggaggcggaggttgcagtgggaggttgcagtgagccgagatcgcgccattgcactccagtctgggtggcagagtaagactctgtccccccacacacacaaaaaaaaaaggaaagaaaaaaagaaaagaaaacacagacaaattcaaagaggacatggaagcttaagctagaagacaaagaggaactagtgaggggtgtgtgacatcagccaaagctgttggcagggatgtgtcctagaaggcagaactttcagcttcctcaaggtcgttccttagtcgttgccactgaaaaatgggtctcgatgggactttgaaaaaaacagacccggcatctagtgagttgctgaaacttgccagctgtaagatctggagtgtttcttttaaactgtaggccggtttcctcatctgtaggattatgtcacactatctaccctgatttcataaggtaatgctatgtgagaatgctctcacttaacttggaagaaggtcaaagcaggatgatgttactttcctcaattctcttttaaagactttcttgagtgctggatgccatgagggaaagcgtatccgaaacactcatgtttctcatggcactgatctagggctcaggggactttgcacatcattgtgttttacctgatgtttaatcccaggcctgacagtggccctgcctcagatctcacgtcagatgggggcgggtggggaggacaaagccttccagcctctgtttctccagtgcagtcaacagaatgagctcctgtcccaagagcctgcaggatataccaacctgagagtcagacttcagcctgcagctccacaataaaaaaaaataaagcaagagtagcccctgcaagacgccaaaacaactacggagcagatcaccatggaaaatgcctcagccagacatgtccaggtccttcagaaacacattgctcatagagaaataagtttttgcaggtgtagtgagagtcaacatgaacataaaccaggcagttcgtcagtggccgattcagaagccggagccaagggtcctgactgagggaactgaggcacacacctttactctctgggtcttagctttaagttggggagagggtgggttagatctctgctttccacaagttctaaaaaatgttcaaaggcattaagtaggggaaagatgatctaataagtttggaaaattctggattcaatgcaatttgcttacttatcctaagatttagaagctattttaagctgaaattctccacggctcccagaaggggtgtgatatgcagttttagcccaaacttaccttgccatgatatcttctttccaggaacgtcagttgtgactgataacatgctggacccgtgttgggaaaactgaactggatgatctcaaaggccttttcccttcagatattctctgactgtgactgcttgaaggaggccaagaattagagtttcatgtcagaggccctcattgctaaagaagtagaggctcagtgtgattgggaaggcccacgtggaactaggtcatccccttcagctgcttcccaaccactgctctgtaattacaatgtgcatccaggaagttatcaaaatcctgtttggagaatattggattagcagaatgtttgattaaatcaataagtggaatactaaggggtttttctcttactaattacatctggaggaactaacctcgtctgtagggatagactaggaagctatgtttcttatgtaaatgaagatagcctaaggaaaaaatatctggaaaaggtaccctttcaactctgatttgtaaatgtcaaatagaggtgctcaaggagaaaagaataaacaatttcatgaaactcaacataaattctaattataataggaatagttgaattcataaattgtgtactctctgaaaagttaaatattagcctgaaaatacaaaaaggacttggatatttcatttttacactcttacatacacacaactttttcctcccaataaataaaacgatatttttgagggacaaatttggcaagttttgcagatgagggtgagaccttattcacttcctcctaaatttaacctaggttaagaatattttcagtcactatttgttgaattctaggtcttagtgttctacctggtcacaatttgtattgagacagaaaccagtgaactcaaatcttcatcagccctcattatcagaaaactttggctggacagctgattgatttgctggttttactgctggcttaatattgatctgactatgtatttcccttggctcgctaaatatatacaaatcaagagaggtttttgatgtcttaaaaggaaacgagtaactgactagagttattgcctaagacccaatatgcaattcagcttaacccacagggcacctgccatgggccacttaatgaggacaccatccaccactgctcatgctgcaagctgccaatgcccttcttaccccttcacctcatttaccccattatctgtaatctgaaattaccatcacctcccctcccactatattttttatccctctcttcttcctcctcacttcccatgacgacacctctgcttcaggtcctcatttcggttcagtagtctcgaaagatctctcttcccattctttcttcaaatgcatcgtgtcctcctcagataaaaagatctttcttgtcttcagtgggtttccactgcctaaaggataacatccctattccttattcatcaaaaaatcttccattgggtggccctgattatctggctttatccctcactgggccaccaggagatgccacacgtgaaaccacatggcacagctccccctcccggtatatacagcacgttgttgtgtctctgccctttggtcaatagtattctctttccaagaatgccttccccacacttttcttctagcaaaacattgctcattcattcaagcctggctcatgttgctcctctgtaatgctatcctactttgccttaaatgaccactccttcctttgtgttctgcactatattgtttatatcgttgtccgttggattcatgcatgtctcttttgtcactagcagtgatatacataaacatcccaaaaaaaaagtagctctgggacaggaatgtgtcagaggccttagaaatggtattttatttagtctttaaaaataagtcatgttattatatacctcatagaaacaggctcacagaggagaaattgaatgccccaggtcacatagctggtcagcagagctgggattcaacccagctgctccgtgtcaccctttgcattgcttcctgttacttctccactgttatcccacctgagcctgtgtgccttcctggggattagtcaatgtgagggtggctccaatactgtgtttctgttgttctgaagggctctgttctttgttcatcctttgttaggagatgtgaagacattctgagggagtggaagataggctgcccatcctcagggctcaagagctggagagaggggataaatgaggaagtgctttgaaagtggacacaggatgacattagttaggcatgaggcataatactgctgggagaatacaggaaagtcattctccttcgacttcctcacattatagtttttgtacaatttggagttaatcaaagagtagataaaccgagaaaaatgtgtgttcaacaggaaaaatggcagggtggggctgttctaaacctggggcagcagttccccactgtatctgggacagagtcatttaatttcagtagtggcttttgaatctgtgaggcccacttgatcttctactcctatcagctcagtgactcattctcccggcaaagacttggcgtcatcccagggaggcagagaggccaactcagtggtacccacaggaccgagtgagtctctcacaggctgcatccacgccccccatggcctctgctaatgaggtccacacctctgctcagcagcctgccaatgtgatgggacacaccccatgctggaagagctcccaaaccagactttgtggaaacttgtggctgcaggttcaaaaggctaatttggttttccactgtgcacagggctgccactcagtgcagtcttcagattgagaacacttcctcccactatgggcagtttggcgtgaatgagtgagatacgtagtttctggatagcacccaggggaatgccgaggatgtgcacacaaagcaaggctgactgttcctttgctgtttgtctactttttcccattttgtgctgagactcatctttccagcacaaacaccagggtgaggaattggaattttagtgctggaagtctccagaactatgatctagtgctcattccctctgatcccattgccctgacattatctgatgcttccacagctccttgtacagggaggtgtggagttgggagagcagcagcctgtggtacagggctgcccacagggaaggaagaagacatggcggggacatggcctgactcccgatgtgctccttcctgtagggtcttccacatggctgggctccctcccgtcccagcacacatcctgggtccatgtgaccttgagcttcacaaggtcaaatctgtgcagatccaaatggtgtgtggatctaattttcttcctcaagaagccttgcacaatctggccctgcatgcttcctctgagcccacacttcctgtgagcatacacttcctgtaagtgtatacttcctttgagcgtacacttcctgtgagcttacacttcccatgagcttacacttcttgtgagtgaacacctcctatgagcccacatttcctgtgagcccacacttcttgtgagtgtacacttcctataagtgtatacatcctgtgatcatatatttcctgtgagcatacacttcctgtgagcttacatgtcctgtgagtgtatacttcctgtgagtttacacttcctgtgagctctcacttcctgtgaacccacacttcctgtgagtgtacacttcctgtgagcacacccttcctgtgagcttacacttcctgtgagtgaacacttcctgtgagcccatacttcctctgtgtatacttccagtgagtgtatacttcctatgagcccatatttcctatgtgtttacctcctgtgagcccacacttcctatgtgtacacttcctttgagcccacattgtgggtgtacacttcctgtgagcacacacttcctatctgtgcacttcctgtaagcctacacttcttgtgaatttatacttctatgagcccatagatcctatgtgtatacttcctgtgagcccacatttcctccgatggtatacttcctgtgagcacacacttcttatctatgcacttcctataagcccacacttcctgtgagctcacacttcctatgaggccacacttcctatctgtgcacttcctttgagcatacacctcctatctatgcacttcctaagagagcatgcttcccgtgagcccacatttcctatctgtgtacttcctgtgagcatacacttcctatctgtgcacttcctgtgagcatacacttcctatctgtaaacttcctgtgagcatacactttctgtgcacttcctctaaacacatacttcctctctgtgcaattcctgtgagcccacacttactatgatatacacttcctgtgagtatacacttcccatgagccccccttcctctgtgcaattcctgtgagcacacagttcctctctgtgcacttcctgtagcaccactttctctctatgcacttattctgagcacacacttcctatctgtgcacttcctgtgactgtacacttcctgtgagtatacactttctgtgagcccatgcttcctctctgtgcacttcctgtgagtaccactttctctctgtgcacttcctgtgagcccacactttctgtgagtgtacacttcttatgagtatacacttcctgtgagcccacacttcctctatgcacttcctgtgagcacacacttcctctctgtgcactttctctaagtccacacttgctgtgtgcattctcacctgcacaatcactcttgctcttggggttcttgcacatgattctttaccaccccagaactctggaaggtgttgctttctgagacctacctctcttgtgtttctccaatgccagttcatccatagatttcttcctaaataccactggcctccctgtgcagtgctttcactgggacctgtgttttttcttggtggcacttacatagaaggattgttgtttaatgacagtcgactccaagactgtcattggtagatggtggcttccaaaatggcagaaccaagtcagccttgttctttgtggtatctccagggtcagccttccctggtgttcccaaatgttccctaactgaaaggatgtattacagttgggcttcctctccctaggagacataattaaatttaaaagtgggcttgggttgtttgtagtatgcagttttttacaggggaaccacagaatctttattccagatttttgaaaaggtgcgcggtgcatttcatttagtccggtaagccgtatttttgtgttctgttgtcaatacattttcagacacacatcacttgcgaaactcctaaaatcttttcaaaatgctctcacaagcacataaacacatatcttcttccttattactcaggcacttcagacccagagaattgcttttagagatcttgatcataatacctcaaagacagttttctttaggaagataaagaacactaaaatgttaataatagaaccttgagaccctctgaaaagaagacttatgtcagattgataatttaggtagagttctggaaaacattaatctacaaacatatgcctgatagaaggatatttgcagaaatggctgcaagtgcaatattgttccagctggtgagtgtggtccataaaaattcagtctttaaaaattatagtatagtctaattgtaggactgtgtgctcagtgaaaatgcactttacctatagatagggttgggagaaccaccctgtcttaccacagtgtatgtctgctcaacacactgccatgacctgggaagagaactttagggggacattcttatgaagcccttccctatacctttttgttagttccttataatcccagaaattttttattagggtagataaatgaccataaaacgtttccaccccgttgaggatgtttcttaggacttcttttatgacaaccatctaaactcagccacatctgcctctggcgtgtctagtttggggccacctctttgcatccccctgtgtaattattttatgagtgaagtccctgctggaaaccagccctcttcccagtcaaaatccatctgtttctccactgcctgtacatgcctttctctttacaatacagttagaccatttgagtcaccttctctagagagataacacaaaagcagaatcacagacatgtgcaatcttccagtaaatgtcttccccccatacaccatgtatggggttgaaaaatggtatttctataaaaaattggaatctgtgaagacagggttacagtgagaaatattaatacacacattgcagagcaggctggtgtcaggttctgtgccaagggtctgtggtgcctctgacaaaggagaacaatgctgaggggacgaagcagcaggaggagatggtggggggggtgggggggtggggggggtggggcgagctaattatccaaattggaaaaggcccaagccccttggattaacacacatcttccctgctgaagaaagtgctcagggaatgatcatgatcagctgccatgacctccacttctcctctcacagggcaccaaaccaacatgcatcaggtggatggctgttggtgatttacatgggaaatgactgtggtatgcagggatgcaaaatcagtgtggcttcttcctccagaagtatggggccacccttgcctcaactcataagaatacactgatgttctggtgttgcctcagaggccttagcttacacaattcctggggtcagggttgggtctatccaaccctagggtgtttctgcagaaaaacatagaccagtgttcctaagatgccagcctggcttctgctcccaatctgcttcctctgaatcatacctcttctttgcaaacgaggtgtttttgtgaacagaaaatatgtggacttgactgcttcatttactctctcagaagttcattaaaagcttacatacacaccaatcaaggctttttatgagacacagccaagatgttttatgtgtatggtgccaataaacacacttctccagaaggaactagtactatttatgtaaagtagacacttaattcaactgaatggaaatagcaaattagagaatgcttgattatggcattgaagatgctttctgggatgaagacattatttggaaaatctccagatgctcaaagcttgaggaatgctgggatcaggcaggtaactctgtaatagaattggacagagactaattctgctcaagaacagctcaaatggaaagctcagatccacagggaaggagccaacccagtccctttaacttggctatggtggatcaagatcgtcactggaactctttggttgtgagactcaatatttattctgtgtaggcaggagcatattggacccatcatgaaactggtactgtcataggctagacctgtgacctcctaggtgaaataacaaaggctggaaagaggtgtccccatgggctttggggaagacttctcttgcccaacagtgagcttgagcaattacttttctaaattgattggtttattaaagaaatattaattggacaagacaaccatcaatgtgaacctagttcaacacaaagaacattcaggccatcagatgaccaaagtgaagcttcctggtacttagcatctgccttatcaactcaggcctgacaaggaaacatgtcagttgctggagaaacacccataccctaaacacctcctgtcacacagtggcaacctgaattactgtgaatccatttatgcggctctcttctctaagagcagaggaagtaggtgtggccagactcagaggaggtcctcaagcaggaggtgtacaagtcagggttctccagaggaacagaaccaatagaaggtagatatagacagatacagatatataagaggggatttatcagaggagttgtctcatatgcttatggaggctgagtcgcatgcaggccatctgcaagctatagaatgggggaagctggcagtgtggctcagttcaactctggaagcctcagaaccagggaacctgaaggtgtaactttcagtccaaggccaaagtcctaagaacttggggtgccactggtgcaagtctcagagtccaaaagccagagagcctggagttctgatgtccaagagcaagagaagaagggtaccctagctccaggagaatgggaaggagagggcaaattcacctttcctctgcctttttattctatccaggaccttaaagtgattctaatgccagtctcttctggaaacatcctcatagacacacccaaaataatgctttaccagctatctgggaatcccttaatcctggcaagttgacattggttaataaaattagccatcgcagtgggtcagggagaaggtggccgagtgtctgcttcctgtgcggagggcaccacaccttctgaatgacttcttggtccctcatagcctaagaagtccggtgaaatgcatttgatctcttgactactttttaccccatcagttgtaccatccaccttccagctatcttcccacttcatgcccatgattccatgcactatttatgctggagcactacaactaagaagtctcttttgcatttctttcttccctccagcaacacatggccctttatgcagctctcacagccagtctgtatgagagacagaaataatggcattgcccttgggaaaggagaaacagataaagattccttctcttgacttctagcggcaagcagtgacaaagtgccccacaaaatttaaagcatcaaggagtagcccgtgggaagatatccatcagatcctccaatatgtgaattaggtctgatggggggtagctgctcactggtcatgatatcttgggactcctgcttctatccagcccctacatcgctctttcatgattttaaatgtgcactcaaggagctcactccaaatccaagcctacatgtatgcctaacctactccaaccagagagctccatatttatgtgaagaaaagggccatatctgattaaacaaccatgattctgtttgcaaacaccaatccacacattatgaaagacacagcaaatgtccccaaataattgattttattcacaccaagtttactctgacggattaccacaagtaaacatgtaaacatgggtaacacttcactatagtatagttcatgccacttgcctgatagaaaaccatggagcttctcttaggaatccattttggttttggggtttgtttgtttgtttatttactttttttatattaaaaagagagatgaggtctcactatgttgcccaggttggtctcggactcctggactcaagtgatcctcccacctcagcttcccaaactgctgggattacaggcgtgaaacactgcacccagccaggaatcctttaaagtacaaggaggattcagcttattatagagccagtctatacacaataacctgaattatatacctaacatgatctaaatccttagagttttagaaacactcaaaaatttttttaagcctcatttctaataataacacagtgattaaccacaatgcttggcgaattgcctcaaaacctttttggaagtagggaggatataaataaatcagttaatacataaataaaatgcttgcagctcagcgaccttctggttctcaggtttccatatatcaaattatggattgaccccgctaagtaatctccgaagtcttttctatgtagaagtctataaattttctgttaatcccagggtgagttggggaccattttgtcttttgtccttgtcgactgtctttgtgagaagctgagtctgcttacctgctgggttcagtgagcaggtatgaaggcatcatgtatggacattgaagagttgcccagagataagctctcacgtttggagaagcatgggtgtgtgggctactgttggcttcagcttgtgtacaaggatattcaattttagaaagccataattaatagtttctcttcttaccatattgaagaagtcagcttgttgccttctggcgaattaaaatttcattaaacttttcagttaagaaaatacagcttgttgcaaaaacaccatatgcaccttacgactcttttccccacccctcctcagtgcgactcccatcactgcacaggtggaggcagtgaaggggatgccttgctttctgagctgctgaaaacatcagggtttcagttctgtcttgtttactgctctatctgatcaccttgcattgtgcttggcatgtagtagctgctcagtacataccatttgaatgaacaaatcaatcaattaatcagttaatcagccagtcgatgcaggtgatgcctgttcctaaattcctttggtcccagtaggtactttgcaacatttccctttcttctgcttctgttagaagggacctttttaaacttgaagggcagaggcccccacgcagctcatgcagatggtggtactaactggagaagcagttacagttgtacctagcatgcatttctgttggagctcatttcaagtaaatgacttatactttatgtccacagcaaagaggcccacatttgtggcaatcttggtcagtacagtcaggaaggaagtgtagctgaagatcactgaggaaccagagaaattagtgtatatctggatttaatgatcaatttgcttatgttaaaaatacatttgaatatgatttactgcccttcagttaatgctagttccttgcttgcagcaggaccaatcaaaaggagctaaaccttaaaacccagatggagatgttgaaggattctagctaaagtttatgcaattaattaggcatcccctattcagaatacactttctatttgtgcttagaattgaaagatatcgtactcccaggaaaagtacaaagaggaccacgagatacattgataatgaccttatccttaattcattccacacatactcagttaagtggcttaaataagtgatagagattttaatttaaatgcgagaatataaatgggcaaatatttgaatttaagtgaaattaacacaacgtgccaaatattgaataagaaactggaatttagttggcattggataatgtatttggtttgagatttgggtttccaaactgaatatataaatcaatgggcagatatacagtgaacacaaatataaataaacacagttccatgtttactgtttataatacgtccccccaaatatgtgcagaagtggaatgtgaagacaataaacaacttttttgttaggttgggggcaggggattctgaaagctacaaaatatcaaaccatttattcattgcatcccatctttaagatacagttttcatcaatatattttcaatgtttatacatgttacttagttctgttctttttctactcaaatgattgtacagttgattaatgtcacatggacttccattgtgattattcttttagctctgcctattcacattattaataaaaccatgaaaattaaattaatatgaccttatcattgtaatcactactttcatttttgcatttttctactcacttttaccaaaaaaaaggaacaagatgggaaaacaaaaattacataaaaacttcagcgtatggggaaaaacagagttgtctctaaaaaggatctgctctcggcatggtagcatcagagcatctactcaattgtcagccataaatgaagttcagaattggacacaccttcacagtcttccatatgccaaagcggattgttccaacatcagatgactccctgccatgtattccttgttagtttcctatgctaaatactagtaagataccaaaggatgttagaaatctgaggagaagttgcctaggatttagagatcactcctagtctaatatcagtaggtttttaggattacaggttattcaagggctgcttcctgtgtgtagaggttgtattatgagtcctgaaaggagagagaggaaaagagtctgccgtattcagaataaaaaggcaacaaagacagagtgttttgcggattgccagataagtcttttctgaccgttcccaatcctgaaagttctaacatggagactgcttggtctttgaaggaggtgaattgcagtaaacaaatcatgaattatcatctgcagtagatttgaaagtctttgagtgaatataactgggggatgtaaccttaactttcagataagtttctaaacagttcagcatatcattttaaaatgagcaatggatgtttaatgaagaaaatatgaaattcaggttatcatgtaaattacaggtaaacaaacaaaagggaaatacaaaagtgacctatactctaatcacccaaacagaatcactgttaacaagttggcaaaattctttctgggatttcctaggcatctatagtccaacttagctctatgtttatttaactacatttatgcatacaaatacttttctttacaaaatggtgtgactttattctgtaacctgctgctttgcatagaaataaatgatgagcatgttttatgtctctaactacacatttatcttgtcttaatggctgcttggcattcatttcttgggctatagcttcacagatttagctactagatagtctccaattatacgcaatagcacatatacctttgtgccgttttttgtacatatatctttgtacattcattaaataatttccttaggataagatttttcacaaattaataggtcagaagtatatatttttaatacatatgaggtgtgttggagaattatcttttagaaaatttatatcagtttatattctcaccagcagtatatgagggaatctgttctaatcagacattctcaacacaaggctttatcattctttttaattgttgccaacctaatagatggtagactctactaatttgcattttttgattacttactaaggttgaatttttttcatgtttattgacctttttctcttgcctctttgtgttcatttagccctggtatttggtatgatttctcctaatgctttgcaagttaataacttattcattaattcactcatttattcatttattcatttacttatctacatctctttcttttctgtgtgttgtaatctcatcccccccatactctgagctttaatttgatttatggtattttgtggcatataaaaatctttccgttttatttagccaaatttaccaatcttttcaattataattttagacctgaacaatttgggatctctgtgaattcagttattcatctgcatattcaagctaaaatagagcagtggcttagaaaccatctttcctaaaactatgacaatgccatttacagtaagagtcaatgaaatggggggagagtcattcaatgttcagaatagaaagatttagaagaatggcaaagttgagcatcatacctttatgaagtgaattgtgtccttctcaaaatccttgttttagccctcacctccagtctgactgtatttgaagataaggcgtttttttagggttacatgatgtcataaggatggggccctaatccaacaaaactgacatccttataagaagaggaagagacagcggagcttgctctctctgccctgtgaagacatggtgaggagaaggctgtctgcaaaccgggaagagagccctcaccagaaaacaacccctccagcaccttgaccttggatttccaggccccagaactgtgagaagttaaatttctgttaagactcccagttatggcagccaagcagactaatccacttaggctgatgcagtcaccagttctgctgggcacaattctaagatgcctcccaaaatgctcacttggccctggcgcctacacaccatctcccagttgtttactcaagcactgatttcagtgctgctgcaatgggatttggttataattaaggtcctggatcagttgccatccaaatggggagataatctgggtgggcctatttaaacacatgagccttgcttttagaaagacccctacagctagtcacagaggaggcgactagagagactttggatggcctctaggaaagcagacctccttgtcatgaactgcctgggggccacatgtaaagagctgcaggtgcctctagctgagagctaaaaggaaagaaagacccgagtcctaccaccacagggccctgagttctaacagccactgagcttggaagaggactctaagcccaagaaagaaatatagcccagccaaactcatgggaccctgagctgtgagtccgtttaagctgagcctggacttctgacccactggaactggaagataatgcatttgcattgtcttacactggtaggtttataggattttgtcacattgaaatggagagtgaatgtgtcagtgtttacatccctgcggagcaaggagggtgccagctacggaggtggagtagggggcctggctctgcagctggggcatcgcagacagcggtttggctaacggtgcagctgatcttcgcaagttcccaccctgctcctcatgaaacacagttgcgcctcgaacaatatgggcctgaactgcaagggtccacccaatgcatattgaaaatacagaattgaaggaagaggaaggggagtcccgcatatacagagggctctcccatacagatgagtggaaatgccaccgggtgaaatctgttggaacatccatacagaagcaaaatattagggaaacaacaggttacagaatcctccttgaacattttttctttcagagaagtcaagtgtgtaggtatttggagctaggctaggtgataagagggacgtaaggaatgtggtgtctgtcttacatgtgaatattgaggacccagtatctacagccacaaagtgacgaccaggtatcacccagcagcaaacttctgaaagtcacgctctgagaagcctctgcctccgatctggggccttcacctttccaggggcccaccccatccctcctcccagccttctgctacctgtctctccacttcttctacaagcaccctctccaaaactgccacatgttctcctgactttgtgtctctgtgggattgcctctatgatgtatcaggaggacgtgtggttcaggggccaactgaaacaccatgtcctttggttttttgtgaagccatcccccatttcctggaaccaaaatagatcccacagcacttcctgtgtaccctgatacctaacaaaatgttttaaagattgctttagctggagattcttacatatgtgtgtcctcctgggacagtgagtccggcaaccaaccctcgctgattctttccctccctccctgcctctcgcagcagctggccaactgccccttctccagcaggtgctccctgcaggcttgtgaaatacactggagggcaattgtctggctcagactcatgttgccatcagcaaatgaccacgtttaagaatgttatgccacctctatatttggcctgcattattcatataaatatgcttggtagacaagggacagaaggcacttgtgtcggagaaagacagtttaaagggcaacgacctaacacactataaaatacagggagtggggagtggggtggagggagcaagccgcgcggctgccaggcagggccctgctcccctgggtgcacttcctccctgctcccgtgggtgcacttcctccctgtccagggagtgcactcgcttcattgcccagtgcgactgggtctgctttgcaggggccatatctgtctgattgtgcttgggcagatttctcttgtctccacctagctggggtgattcaagtaggaaaaaagaaaaccctcctgcacagattgtgcgatcatttcatttccttgcctttgtttgtcatttctcctgtctgaaaaaacagggaatccactaaaggccagaacattgtactctgcttccatcctcatgaaatcttggcttttctttgcaggaagcgtccaaaataacacaggattggtcctggggtcccaggcaaaagtgagaggtcagaagggtctccatggttctcactcctctctctgtgaccttcactagctcacttccttcctgcccagttctcattctctcgtccagtcttttctttgtcttcctgtggatgaatacatgcataaacataagaataaaggcaaaagtctcaatggaatctatcaaactgttcattgttaaccactttcctgtaggttgggtgggggaggttttactttcactttattcatttccttccttccttccttccttccttccttccttccttccttcctttctttttctgtcggagtcttactctcgctcagactggagtgcaatggtgcaatctcagctcactgcaacctccgtctcccaggtacaagtgattctcctgcctcagcctcctgagtagctgggattacaggcacccaccactatacccagctaatttgtgtgtgtgtgtgtgtgtgtgtgtgtgtatatatgtatatacacacacaaacacatacctatatatatatatttaatagagaaagggtttcaccatgttggccaggctggtcttgaactcctgatctcaggtgatccgcctgcctcagcctcccaaagtgctgggattacaagtgtgagccgcagcacctggcctattaatttctgtatttgattttttttacagcacatgaaatagttttgatgtttaaatgaaggaaacaaaagcagtgctttcgatagcccaagcttatctttcctaaatgaacccaaacctcacagttattccctttacttcccactcccgatcacacttgtcccaggtggatcacgtccgagaccagcactccatgaattttaggagccagagcggaccgtgaaggtgtcctggtagctgaggtcctatggccgctcatgaaattttagtgagccatggcttccctgaggctgtggcccgcaaagtctgaagggagtcacctccttcaaatccactgagcaaggcctggggagtaatgggaggtcccccgtctgactcacacctgacagtcgggcctgtcccatctctggcaccagcaaccgcccggggacggtgagggaccatggggtcagcctcagactctctgcacatgtttgctggccaacgttccagccagcgggcctggactggagggctgggatggagagggtggggcaggaaggcagagcctgccctgagggaaccgggaggtgttccgcgcaggctctgctgctttctgacgtgtgaccgtgtgcacaggatttgtcccaagtcccacctgcctcttctggaaagtggagcgatgatgtgagcaggcacagaggtcacaaggagaattcagggatctagagacccccagagcttgccctgtgcccatgctgcagtgggcactctcctggcatggccacgtctgtcacgcgtgatgctcacagcctgctcactactagaaggctttaattttctgaagcagtgatatttaatttatttgaaatttcaaatgtcattaaaggagacgtgctatttttaggctaggaatttaaaatgcttccaaaatgcctcatccccatcgctcttattgcaagcatgtattagctgttctcacgcctgctgagaatgccctgtgactgaagcaggggctgcttctgggggacagtgcagccaccatgtgggtcaatataaggaaatcaggatgatacaagtgatgtgggtttgcaccatcatcctggctgctctgtgtgctgacgtgtgtataacattgacacgaggatgcctgtagcagatgggggtttagctagaaagcaggaggcagtgcacgatgagtatggtgcagtatctccagcagacctatgctgggcagaaacctcacagttctgtccaaagggagcttcatccctccgatggccattcccctgcagtccgtgaacccccaggatagctgcaccgcatcagcagaacaattgcagtgcctttacagtgaaggaacacaggctccagctgtcagctccatctcaaaacctacccaccccactcatcctgcacacgctgccccagccccatgccccagaggctgcccaagcacctagcgaagccctccaggatgcttggctctgggcctgttgtttcaagccctgccctgccttctggctgctggatggggaattgcagtgagattccttccctccgaagctccatctggtgcaacatctggagctggtcccccagcataggaggatgtgagtgggatgatgaatggcacctcagaagtgtgctgttggggagggcccacctgtttaccaacatgattgcaaaacttaaatagctctggggattctgaactgctcttcttggggggctccccaccgagagcattttaggccctgtgcatagcaggattataaaaaagtcatatttaagacttgatcatgcttctggcatttggaaggaaatggatggatgaagaagaaacagaaaagattatagagaactggaaaacaacaatttaactgctaggatatgaatcccaaatgttataggggaagttctgggatgaagagaagacggagcaatggctgccactgactcagtgatgtgtaggacatggggaagccgggattgtggacactccccaccgtggtaccccccgctccagtggtaccctcccccgcccccggcatgggcagctcagaccaccgggaaagttccagcaggcagatacattgcttcccacacaagctcattgggagaaggcggctctttttttctcattgttacaatatgatttgattcgtggtgttgtaatgattagcaagcagaaccaatgtggtttctttccccagcatcgcttgaatctacagcaaactgtccagagaagggatcacagtgggattctgatgccttattatgatgtcaccttcacgaggaggtttagaggtttgcttttgttttgctgttctaagaaaaaagaatgtgccatttggacatttcaccttcaatttggaacttaaaaatttagtccataaacaggaaataaacagaacttttgagagctccctctctcatttggcaaggccccccacttgccctcagcacttgggcacccaccttgacttacagaggaagccctggaaacagccaaggatgggggaaaccaatcctgggagcacaggggtactcgcctgccaacctgctgacctctgggaccaaataccagggctccgtggagacatggctttttctgggaggatatactgaaaaacagagcaaaaggggaattgtttgctgtgtgagattgccaagtcagccctaggaaagaaaggcccaagggcacatctgcagaaggactggagggtcagtctgagctcatatttgccaagtctccaaagaataggcatcttatggtctcagcacgagggagaagagagaatttcacctaggatggcttccagtaagcacctgtgatgtctgggttctctccattcccaggcctgagagcggctgcacagtcctgattcctggagcgctggcccaggccgggtcctccatgtcaccccctttaatatctacatttattcatgcagacgcggactctgagcaaagtatcaggagcctggtgattcaagttgggagaatccaccaaagtgctttccccaccaggattcactcacttgggcctctttggaggctcttcctccccactctcctcttaaaggccaggagagaggctggcaaggtcgcctgtctccctcctccacacctgttcctagatagctgcttcctgccgggactccgtgatcttgtctgcaatgggtccagatctgtagactgtcatctaacccctagattcctacagcggactgactaccattgtccgtgcatagcaagcttgtccctaaagctcagacgatggcctccccagtgcttccccagaacccgatgtggttttcagtagaggcttcttccatggaagctgccaatatgtgtcccacctgccggcattagacctggggcacctgattgcttctgcccgccccaggatgcttgccccaggcctctcccatccatccaggtcacctcctccctagaccttctcagcagcccctggcttgtctctgagctgcgggctttctgttcctggactgcccttcaccctgtccccagagcctcctcagcactgatctgattttgtcactgcattcctgtgcttgtaagcctgtgaccagcaatactgtcacttcttagaaaacattttggtctcgacacggttcacacaggcaatgccccgccatcattgcttccaattgtgttcgacgggaagcagacagtagcagcgacggctcttggtgctcacccagacctcccttgctgggaggttgccccaagaccctgcagcctgttactgatggaggcaggtacacacatagccatccccttgccctccctcagggaccagctgtgaagtacagtgcgtgcgtgcacttccagatggcattcgactgcagctggtctccagttgggaccacatcagtgcctcccgtctcccctaccccaggccacttccctccctcctcctattaacatcatgctccccaataatccccacagccccgcctcagcctctgcttctggggaacctgacctaaggcaacagcaacatttccctggggctgaggaggcaggcatgcttttaaagaggcttttccatcacctttgagcatcacctgcctacgagatcaaccccacacatttgagtttggcacatgacacattgcacggcctggcacggcctttctttcctgccttcatctttcgcctctctatgccctgttctttgagcttagcctggggttctccacagaaaccacactgttggactcttttatgccttggtgcatcctagatgtcacattacagtagtttggagagacttttcttaggtgtaagtgagataaaggggttgctggaggtgctggctacagggcagtgacagagaaagcagtggggtaggcttgccacatggaagagagcaggtgaaggaggagacataattttttcacaggaggcagctgctgcctgtccagcacatgaaccaggggtacagggatggggtgcgaccagcagctaatctaactggtgtatcttcacattgcatgttaccatcaggatggagagagcaggtgctctctggaccctctgtctcccagcctgactcttcccaagactgtgagcacctacagagcaggcctcaatccataaccttggtattcttgtgttgagttttatgcccgctgcaatgctagactgagatgcctcttgtatggaaaatatttcttaggagtttagcaaatttatgtcattggctgatatttcaggccaatccattttgggattagaacattatcaggatgtaaccttagagttcacttagttccggcaaaacctcttaacttcagttccctcatctataagaataagggattcatttgtgatcatatagctcaggtaatccaggaccagaaacccaggagcgtgggacctgatccacagctagaggatgggggactctgtagctacagcattttcctgaacacacaagaaatccagtaagcagcacacactggctgagtcggctttccaatcagaaacaagcccttgacttgccggagttggaagactgcaagtacctgcccaaatgtccacccaacagataaactccctgttacgtacataattacaagcattctttacctgacagtcccatggctggacaagccaagctaagttttcagtgtacataaaaagcataaaacccgatgaagtggcctgcctaaaaattaatgtgatggccgcaattgcagcttttgtggccctgacgttagtctttgaacgagtctgccttctgggtcaagtgaacttttactctgggattatagaaagcaaagtaagtgatctcaactccctgccgcttatacaagaggggagttgttacttttactttattttattttaagatggagttttgcttgcccaggctggagtgcaatggcgggatctcggctcactgcaacctctgcttcctaggttcaagagattgtcctgcctcagcctcctaagtagcagggattacaggcatgcaccaccatgcccagctaattttttgtatttttagtagagaccgggtttcaccatgttggtcaggctggtctcaaactcctgatctcaggcgatctgcccacctcggcctcccaatatgctgggattacagtagtgagtcactgagcctggccttattacttttagataaaaggcacttgttacatcagccatttcacatccattgataaagatgggtgcttctgaaatggccacagctgacagccaatacacctgcaggtccaccctctgctggtcattttctgaccacagtaagtgctcagcagccatccccagagcaggggtcagcaaaattctacatcaagggtcaaatagtaaatattttaggctttccaggacctacagttttcctatcaactactcaactctccttttacttgaagcaatagtcaacacatagatgaacgggtgtgactgtgtaccaataaaactttatttacaaaacaacagcaggccccggggccatagtttgctgactgccgccattgtgtagcctgaagtggagctcagaagcaggggctccagccgtgggtggcaaactctcaaacccaatgacaccaacagtatctttggttagagcatttagagttttagccatagttcaattagcagctgatgatttgttcctcgatcagcccaagcatgtgaaacataattgttccttcaattcccatcagccaggaggtgacagggaaatgacctattagctgacttcaggcagcaggaaaagtccaaagttggctgctgccattgccatattgattggtgatccaagagaagtgtggtaactatgaccaagaagaaaaggtctaggggaactattccttatattgtggaaatattccatacttcgctgggatattttcactgaaatcgttttgaactgagaaccagggccattcctctgactgtaaagctttgtagaatatattcaattctgcatgttactgatgggtgctaaccttttgtgtgtgtttgtgtgatgttcgggcttaagggatctctggacaataataatgataattcagctgcctgggatcttgatgaaacccatccactccttcccacctttcccatgtcagatcttctacaaagcaaactgatgctttcagtaaaatattactgatgcaatccaagaaacagaaaaaacagcccaccaatttactcccatttgaacccctgaagcctgttcacagtattaccacattgttattgaagtttacagaacaaaaccatagatggaacccaagaattcttctagttcaagcccattttagagctagattgactgaagtctaaggtgatgtgatctatgtgatttccccactttcaaatatctcctaagaaatggccatagaatgtatgagatttctttttaaaagaactttactcatactgcatacatgcatgtacacacacacatgcatgcacacacaccaaagctcaggatctcctttgaaggagtgtcgagctcacgaatggtaagagcccgtgtggctcaggccctctgcagagccagggcagagagacagatgccattttggggacaatttaggctgcacagctgctctctctgaactgccaacagctgaaccaaaatgctcaggaggtgggctgggcagccctgggctgtgggcacagtgtccttgggtatttacaatccctcgatccttgcctgattggttttccataggcagggcttcgtccaagttcctagggtcgcaataccattctcattagaaggttcctcttgagagacaccatggagcagggaaggtcttgggtgtcctcccatctcatttgcccttcccctaggtgcctgtgtttcccatcccagtggggatccaaagcatgtcctgggcattgggtaagggtttagaaccttgtccccgcctgcatatgatagacatggggagggacaggatcaggaggttgctaggtagagcctgcaggtgcctttccctgaactctgttatgtggctgagttcttcagagaaatagtcaggagctaaggggttaaacaagcatccctccctgcagagacaggcaggtcagaggctgcatctgttaaattagggtccaggccacagaggtaatacctaccactctaaactgttagccttccaatactacactccagttctgggagtgagtaactgtgtgtccagagatagaagccataagcacttgagttacagaactgctgagaaattggtctgatggtctagtagccttgtgccaggagaacagttcctatgtagaaactggtcagcattttcttctgaaaacgtaatcatcattgcagtgagtataaacttccatttatatgccaggaacctataagtttcagaatgtgtctgatccctgaagatgtcccttctctcagacggctggcccttgccccactgttgctgggttgtgtataatctgtatgtccagtcaacctcagctctcagcctctgagcccaggggacagaaggccgtggctttaaatgttcacttaaatattgtcaaggtagtatgtttattgtgtactcccaatggttgtcttagaaaaccaaggatggtgtcatccttagacctaaggggccccaggcctggcagtgccttccttcagagttctaagctccaatgcctgtgtgtggcctggctcacagagccatctgagcaggacccctgagcccagcctgtcttcccctcttggatgttctccaaccctccacccacccgccccatgcatgagtcaaccagatgccctgaggagctctgggacttgcacctacagggtcatcccgaggccctgtggccagataggcaccaatcccaggagagtggggaggtgagctcatctcttttgcaggccggcatggtatttctttggcaggatgctgtgagactgggtcccagaacagtgctggcctgttcattttggatgactcaaattgctttttaaacaggagtcctgaaaaaagtatttggccaggcccagagtactataggggcagccctgaccagggaaacattaatataccctctcccaaaatacaaatctcttttagactgttgccagcagtctcaggaatgatcaatactagtggttgagactagagggaccattaagtaagtggagttgatctttattggatatagctggccctctttggtaagatgtgatcagaagagaaattcaggcagcaggctacataatcttcatagaaagtaaatttcaaatgcatcatacaaaattcacagacaaacacatataattgcttaattgcttccttgtttaataaaatgtctttcctgatcaatacctcttaacaagttgaccaaaccaggtatagtttagcctcctgatcagatttagaccttgaatttaatggaggtatagataggtaggtaggtaggtaggtaggtagatagatagataacccatgaatgttgaagaattgtgtctatattaaaatttagccaaaggagaccagagtaatataataaatttgttcctatgggaaaagcactttaagcaaacatgtgccccattggtgggtggggaggtatatattggtgctattttttgtacagcattacattgtttccctggtggggaagaacaggttagctttataattttgggagagcaatttaatttaaaagatataccctcactgggataattaaatcctgatgtgtgaggttctttcaaatggaagatttgcttaaggtgttcacattttggttattctgaacatttctacttgctgtgttgcggagtcacgatactgaagggcacacatgtttttgtatctcacatatgtgacacatccttatctaaaatttcagagccaagagaaaagaaggaatcagatagtgataacccagtgaggtatctgctgcacagtctgcctctccaactttgctgaggaaactcgaaagtatggaaagccaggagcccggcacaggtcccttcccagcttctgtctcttagcctggcagagacttcagaggaggaactccctgagaatgggaagtcattctctagttgtcttgtgcttcgtgtttgtttttcattgtctttttcaaagtaatgtatgcacaacgtgggtaacactgacttttattggctcatagtgacaaaaacaatagtcccctgcctctctcctcctgaactctggccttgctccccagttgctaatatgttcaatgatttttgctatttcttaccaacaactactttaatatttctccataacatgcttaaatatttgtacttatttgggctgggtacggtggctcatgcctgtaatcccagcactttgggaggccgaggcaggcgaatcacctgaggtcgggagttcgagaccagcctgaccaacatggagaaactccgtctctactaaaaatgcaaaattagctgggcgtggtggcacatgcctgtaatcccaactactcaggagtctgaggcaggagaatggcttgaacccgggaggcagaggttgcggtgagctgagattgcgccattgcactccagcctgggcaacaagagcacaactccatctcaaaaaaaatatatacatatatatgtacatatatatatgtatataaatatatatacatatatatttatactaatttatttagatattatgcattgctttcctactgtaatagatgaagattaactcttccgtattacttttcacccaatttcaccttcccccatactcccatataattatgtttcaattttggttaaaccaatatgagatgattgcattgttgctgaacaagaggtacaatattacgttctctttttgtatacaaagactgttaatttagagacctagagctttcagatcttggaggggttcttctatctcaataactacccaacccccatgttcttttctcagagttcatggaattgaataatttggatggatattctaatttttaaaatttcttttttccatttattttaattctgcattctggggggtttcctaacctttatttttcagcctgtctattggctctaaatttggctaccattcatttaattgctaaggtctcttgtcctgtttcttcctttttttaaaaaaaaaatctcctaaatttctgaatgcaaaacattactatattttgaggctattccgaagaaacagattttgttctttttgaattctttttctctctgcattgtctctattttgtaattttaaatgtttattcatttagtctctgtctttatgaaacaacattcctcaaaggtctggtggtatctgtctgcctcagtagaataataaaagctgaatagaattttgggggctgagagtagagcttgtccactagcaggtgttactgtgattaagcagcgagtcagcttttaaactgaggactctcctatttgatggacttttctctggagccccctcattttcccagggcggaatccctccacctcttgcccagggaacatagctgggctgctgctgctctaggacacgggtcgggaggaggaggctgggaagggtgtctcgctcttccatgcaagcacttgcacactgtcccatcttcaactcagagcctcctcccattccccgctgggactggagtctctgagacctgaataccttaggttcagttcctccagagaatcaacctcccatctcgtgtgttactggaggagggtttttgcccaggtgcctgggctgagggaagggatcagaatacgccttattcagactttcaaccttcctgcatattcacttgctcacctggtttctgcccttccccgcacccgggccctcccatccccgagcccctgctccgtggttcctggcacctctcttggcctcttcttggcgttcatcctcgccaggtacttcggttcctgtttcttcagttccaccaaaccagccagtgttctcccacccatggtctgtctttgattacaggtgttgaaatgttaggtctgatctgctgttctctcttctcactcctcttcctgtggatttttaccttttttttcatttagtgttattttggtggattttcagcagtaaagaggaaataaatacatattaaatccagaagaatccagaatgtttaaatggaagtctttgatcctgtctgcttttattcagatcaaatggatcagatgacttaaatcaaaaggtaatatttatgagacacaaagaattactctctcctctcaacaaaaataaagcctccgcctctaacatcatccagtctgcctcccagacatgaacttgcgcacaaagatgtcagggagccatcaggcacggcactgcctaaaaagcccatgtggcataaagaatgagcaaagcgctacaaatacagggtccttctatacaggttattcacactgatcttcccaacagcactattagttggtaatatgtctatattgcagattaaaaaacatcagatggccagtcgcagtgtctcacacctgtaatcccagcactttggaaggccaaggcaggaagatttcttcagcccaggagttccagcccagcctgggcaacatagggagatctcgtctctaccaaaaatcagaaagttagctgggtatggtggcacatgcctttagtacccccctacttgggaggctgaggtggaggatcccttgatcccagcagggtcaaggcggcagtgagccctgatcataccactgcactccagcctggccaacagagcaagatcctgtctcaaaaataaaaataaaaataaaataaaatacatcagacatagagcggttaattggctacccaatccagaacaccaagtagcaaagacaggacttgaacccgggacctccaggtgtttctgggtgttctttgagttcctccatcctgaatcaatagtcaagcatcatgtataaatggagccacagtcctcaaggataaacactaactgcttgtaggccactgcaggccattcagtacagtgttttattgtgctgcaaagtcacctgtttccacaagtgcttccccaatgcaggctttctaaagtcatcatggaaagtaaattattttcccctaacaaactatgctaaaatgggcaggatgagcaggaagtgcttgtgtggtctacattgtatacaactatcacggaaagttcaactcatgggacacttgggttatctggaggacacatggccgtgagaggatgtggcgcttagaagctcccttcatcacttggttggccctcattcatgcatgctgaggagggggtgggaaaagttatagaagccagtagccaaacccggtatacccaaatgtttagcttagattgaagctttggtgtttctaatatgtacattcggctcacttccagaagacagagatgggggacttgaaaactagcttagcagagagttagttaatcctaaacctacctcgttctgtcaccttggcgatgaaatgactatcctaatacagtcagaagaggacttaataatcagccaggcaggtgcggggagggaatgccagaaacatgcaaaaccgccgacagcaagaagtttccattcttttgggggtgactgtgcataattaagtgcctacaattcccaaattaaaaataccagttcctttacaaccagcagtggcaggtctactcaggggcagtcaggaggctcccacaagtgcagctgtccagcactgcaccacacctttctcttttctccaaaagaaatagttttatataatagatatatccaaaaatgtagaggtcataaaaacaacagcagataaagctgtatccttgttggttttatttgtttgcttttggtgttatgtttagggtaacatgattgctgctgataagaacacattacctttgtaaacccagcactttgggaggctgaggcaggtggatcacgtgaggtcaggagtttgagaccagcctggccaacatggtgaaaccctgtctctactaaaaatacaaaaattagctgggcatggtggctcatgcctgtaatcccagctacttgggaggctgaggtgggagaatcgcttgaacccaggaggcagaggttgcagtgagccgagatcataccatcgcaccccagcctgggtgacaagagtgaaactccatctcaaaaacaaaacaaaacaaaaaaacacctgtgtagagcaagttcaccttttcatagcacatgcagaaagcacacctctgtgagtttgcaaagagaacagccctcttctgctgtgtgacatttcagaagatggaggctcagaagcttcaagtcttattttgctaccaggacagaaacagaagccaaatctttaggcttcagatttacctttttttcctaagagtgggacatcatatttaattttccaggtcaaagaccagcgcttgagttgatcatagatcttctcagagaagtcatctgaaagggaagtagtctgttttcttagtcacctgaaaagccatagaataagataaggcttagaataagaaaatattggtttctccatgagaagaaggaagagaaaaccaagttgaaccatttaagtctcagttgagttgaaatactcaagtgacaaaataatctgaaaattaaaagtatggtgtatctctaaacaattattttagcaaacatactctggttaaaaatgtattctaaagaaggttttatttaattataaatatctatattttgtttttcacctcttccaaaagggtagaataaagtaggaaaatgcacttgggttcatctcgaaactcagaggcagcgtggtgtggggcagagggctagcatgggaggtgggaggcctggtgttggcccgggaacccgcactgaccagcctgtggccagggcctcatctgagtggagggaggccttggtctagaactgagattcaccatacaagctccccagtctgcttgtggaccaggagtgtcttgggaatgggaaccaaactaatccaaagatgaagttcaactctttggttcttatgaagtgaataacccacaatgccatagacattcatttttctatacacttaagggttacaaaaggagttattaaatgtgaataacgtcttgaatatataaaattagactgcagctacagatttcccaggatccattccatattccctggaatccagcttgctccaagagcctggcacactctggagcttttgcttcacccagcaggtacggagtcaaactcgacacctggaatctgtatgttgctagtgttgagtggaactcaacacctggaatctgcattgctaacattgagtggaatttaacacctggaatctgtgtgttgctagtgttgagtggaactcaacacctgggatctgcattgctaacactgagtggaatttaacacctggaatctgtgcattgctagcattgagtcaaacttgacacctggaatctgatcattgctggtgttgagtggaactctgcacctggagtctgactagcattgagtggaacttgctagtgttgtgtggaacttgacacccagaatgcatgcattgctagtgctgtaaggaacttgacacccagaatgtatgccttgctagcattgagtggaacttaacaccagaatctgtgcatcgctagggtcgagtggaagtctacacttggaatctgcattgctagcattgagtcaaacttgacacctggaatctgatcattgctagtgttgagtggaactctatacctggagtctgactagtgttgaatggaacttgctagtgttgtatggaacttgacacccagaatttatgcgttgctagtgttgagtggaactctacacctggagtctgactagcgttgagtggaacttgctagtgttgaatggaacttgacatccagaatttatgcgttgctagtgttgagtagaactcaacacccagactctgtgtgttgctagtgttgagtcgagctggacacctggaatctgtgcgttgctcatgtttggggtttgtacttcagttattttacttgctcatggctttttgttgtaattgttttttgtttcttttttatttaaaaatcatcctttaattatctttagtatcttcagtttcattcactggcttaaccagatagtcgacaattatgtgttagacatatctgttctgaaaaatatttttagccctcaaattttttcaaaactaatttgcaagatgtatacgcactgtagttcaaatgtaaatcatcagtgtcctgattactgaggcagatgtatcaataagatcgccagatttgctagtgcaatgatgcttccttatacagcaaattatttttcctatggggatggtggggagatggatttggaggtgatttatcctgtaagagcaggtttggaaagttaattagcctctggagaaggttccaggatctctggggctgggtggagctataggggtgggaagcacctgggccactactgtgcaggtgtgtgcagtgaggatggctccctgtgcttggcccctctcactacagggcacgccttcttcctgccagctgtcctcagagacaagagtctcactcagcttcagctcaggcccgctctctactgagccttccacctggacttccaagtggaaacaccccaaagatcctcatccctttcctccactcgatgcctggtttggctaccacccataagtgtggtgttctgcctggccccgccaaacctcttccaggcacccaaggtctggcctctgctcaggttcaggtcttgggccatcgtgtattttccttctcagaataggtgcctgggttgttctgactatggtctaagagtcttccctgccctgccctgccctgccctgacctgctgtcccctccccttccctcccctcccctcccctcgcctccttctctttccctctctcccccgctccttccctccttcctccaggaattaagacattgaacattctgtctcatttccatgatttttcaaacagtgccaaaagagccagcaaatgactgtgcgattatctccaccaacctatttaaaacattgtcgttgtgtttgacttgatgtggtccttcatcttgaccatgatgtttgttttactgcttccttgatgtataatttacataccataaaatctacccttttaaagggtatgattagatggtttttagtattttcagagaattgtggaaccatcacccccagtctaattttagaatattttcatcatccaaaatagaaatccaatatccattagcagtcacttcccattcatccttcccctagccttcagcagcctctactctgctttctgtctctgtggatttgcctactctggccgtgtcatataaatggagtcatttggacttttgtgaatggcttctttcatggaggatactgttttcaagattcatctgtgttacagaatgtatctaaactccattcctttttatggccaataatattccactgtatgcacctgtcacactgttcatccatccatcagttgctggacacttcctggctggttttcactattcagctggtatgaatgaggctgctatgaactgttatgctcaagtttttatgtggatataactgttagatttataatcattctaattagccattttgtacttttttttaaagttttttttcttttattatactttaagttttagggtacatgtgcacattgtgcaggttagttacatatgtatacatgtgccatgctggtgcgctgcacccactaactcgtcatctagcattaggtatatctcccaatactatccctcccccctccccccaacccacaacagtccccagagtgtgatgttccccttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatcattttttatgaccgcatagtattccatggtgtatatgtgccacattttcttaatccagtctatcattgttggacatttgggttggttccaagtctttgctattgtgaataatgcctcaataaacatacgtgtgcatgtgtctttatagcagcatgatttatagtcctttgggtatatacctagtaatgggatggctgggtcaaatggtatttctagttctagatccctgaggaatcgccacactgacttccacaatggttgaactagtttacagtcccaccaacagtgtaaaagtgttcctatttctccacatcctctccatcacctgttgtttcctgactttttaatgactgccattctaactgatgtgagatggtatctcattgtggttttgatttgcatttctctgatggccagtgatgatgagcattttttcatgtgatttttggctgcataaatgtcttcttttgagaagtatctgttcatgtcctttgcctgaaactgggtattttattcctcagaaagaaagaggagactcgaacttctaaacataaattgtgtttgaaaatattggagcttacttatcctaccataaaacactcagtttaaaatgagcagttttaagatacttggttttgttccaactaatacctctcctgcctttttttggtcaatttatttttgttattaaaatttcttctgccgttggcacccccagaacaatatattcttcaatagtttaaaggagctgcttcctcactgggatgtggacccttcttccttcttttaattacagcgttattaaactcctccaggttgacactttctttcattctctattttagatttgtcaatcagaggtgctccatgaagcagctccttagtgctgggggaaatgcaaagccatggcgtgtcactgtgggtgcaaacctgcttctggagctgtgacgttcttggggagggagggctgtgaagggtcatcttggaggggccacccctgcatctcacccgtgagccatccttctcagaggatgagagagtggataagagctcaggagctgcaagggagcattgcgggagcactgtgcatcataagaggggaggatgaaaccgacaaagacgggcacctggcagggagtgctagtaaactgaggcgtggactacagaaacaatcctcccccgaagaacttttgaaaatattgtacagacccagggcaccctccctgacctacagaagccaaaaccccagtgtgggagcacagtatgtacgtttagaaaagttttcatatggccgggctcagtggctcatgctgtaatcccggcaatttgggaggctgaggcaggtggatcacctgaggtcaggagttcaagaccagcctggccaacatggcgaaaccctgtctctactaaaaatacaaaaattagccaggcatggtggctggtgcctgtaatcccagctacttgggaggctgaggcagaagaattgtttgaacccaggaggcggaggttgcagtgagctgagattgcatcactacactctagcctgagcgacagagtgagattccatcttaaaaaaataaaaaggcagaggttgcagtgaaccgagatcacaccactgcactccagcctgggtgactgtctcaaaaaacaaaacaaaacaatacaaaaattgtaagtatgtgtggggctcatgtgctgagtttggtgggggaaatctttccatgcacccccacaactgtctacaatatgaaaacaatcttcaagaaaacaccagcgaacagaccattcgtctttccctgttgccacattttatcttggtctcaggctgctgacctgtcagatgattgacaaatggaaaccgtatggtggctcagagggaccaggcgtggtgtgtgctgcattgaggagagggtgggtaggcaaatagaagttaagcaccctaacagaaatcattctaggcttcagagcttagccagtagcttagcaagtggtattttctaggaagccactcagattagtgccaaccttctgcagaaatacagagctataggtgctgggtgagttgtgagcaaagccatgttcagaatatgttaagtttctattttttaagtgagcttatttgctgaggtaatgcagtttgcctgaggcaaatgatcatttagatcagctttcatcttttaagccagatcttgagatttgaggcgctaaactctttgcgtacgcattttacagctctcttacttggttgggatccactgcttcccagtatctgcagacccttctggggactgtgacctgcagggggttaggtagctgttttcaggggggcattttgagcccgacattcacgttttataacattagctgtgtgggggctggcaagaagaatctagccttttccattaatttagtgactttgttcattttaattttttagttaattcactgactttataattttgctaaaccctacaaactgctcagcataaatgatttcctttaatccctacaaaatgtcaggctcccaggcctgcaggctcagagtgtatgcagggcgaatgctgcttgtgtcttatccaggacagactggcctgtctcgcacctgtcaggcaactttactcctgatgctgctttctgggacgccatccaatctcatttggaggttttgtcagtgagcagatctgtttctgttagattcaattgaggcagaggcagacactgaggacagatgggtggctgaagataacaccggggaaaccagcctctaagaaatagagccactgcaattaagacttccactctctctccagaggttgtggagtcaacagaaaagcagatccatgtctgaagaccatgacaccttagaagcccagacagacgagagggaaaacagcctagaagaccttgccttattatttctactctagaaagatgcacgggatcaataaagtaaatgagctgtttcatccaagctggccgcgcagatccagggccacagagacagacagacacataaacgcattgatcaccctgctagggcctactggcctaccctgcatggaaaatgtgaatggaaagaaggcaaggaaaatacactatttgtagttctgagccacagctctgattgtaggtcacctcctttcctctgtggaagggcagtcacattgtgatctttcaaaacattggctaaggcggtgatgataaccaaggctgatatgttaccagcacacagcagatctcagggctgagagtgaggcatgaatcttccaagtaagtggctccatatgggcctctttgaggtctttaaagtcaacagtctcttcatcatggaattcaacttgacccctgttccaccgacatcagaactggtgaggtgacagggatttagagcgacttgtcaaagggatgggaaatgcatttgctcaaatgataatgacattcacaatagtcaagattcgttgagctaggatgcatgctaagaactttacaagcatttctattaaaatctcaacactgctcaatgaaatatgtattatcgtctccatttttagataagagaattaatgtttagaaaggcaagttgatcaggcatatctgtgcagcaaatggtaagactcgacttgaactaaccttagacaaaaaaacaaaaaacaaagcaaagctgtggagtggcaagagcaaggctggccttagggacagcgggatgggggctcaggtgcagctgagaccctacccataccccttctgattgcgctgctggcttctccacttagggaatgagaggagacaatcagttgctattctgagtcatttcctgggtctctgagtaaaaaggagagaagcttcctctcttccagcttcagtttgaagagtctcaggcaagaacccggttggcctggtagagtcttatgcccatccttgaagcaatccctgaagctggaggatacagtcctaagggtcctaagttactgggtgccatatggtggtgggcggggtggggtccatcaccaaaatggagcacagagggagctagtatgaatcaggcaagcagttggctccacttccacatgagatggcagcaggcatcgctaagcctgattcacagcacctgggcttaagttgcagcaccgatacataccagctatgggactttagagagggcattttctctgtgtcttgatttccttcattttaaactgaggacaatcatatctaactcctgtgataattgggtgtgttaaatgaattaatgcattagaggagtatctaatacaaggtagatgcttcattaatgtaagctaatgttatttttaccattacttttactgttattataaggagctatgtatcttgtccaaggtcctgtaatagctaataagtaaaagagccaaaattattattattatttgagatggagtctcactctgtcacccaggctggagtacagtggcgagatcttggctcaccccaacctctgcctcccgggttcaagtgattttcctgcctcagcctcccaagtagctgagactataggcacgcgctatcatgcctggctaattttttagtagagatagggtttcaccatgttggccaggctggtcttgaactcgtgacctcaggtgatccacccacctcggcctcccaaagtgctgggattacaggcatgagccactgcgcttggccccaaaattcttatcagagttacagtgggagatatcacaccatgagctctccttctaaggatgcccaggccctgaattctggcacctacctcgcctgcattttgtaggttgcactgatttgcttagtggggccacagtcaacaggctctgatcaaagccacccttgccgcagctgacccagcagcctgcccagctccatccagggctgttagcccatcctaaaaaggccctctccttatagaccattgcccgaggaggtctttccaggccctacctcctgaaactcctctctggcctagtctaatatcccttatccttcctaactttcctaagtttccagtcctaacttccctctccacctgcaccttggacatgatgattgacactgtgacttgcttctcaaaatcagctcccctatcaggtctgttttgttctccgtcctgaagacagtggtcacgacctcgcccaaccctgggctggggctcagcctcctgctcattacaggggcagacgtgccctttgatgtcaggcctgaatagaggttccttatttattacaatttattatcctccgaatctgcctggggttttgatagaacctggctgccaacggcttgccctggcctttctgaaacctcaccatttccacaatgaaacaggacgcaaggactgtgcccctggtatgggaagggaaggaggagaagcttgcgtttacaagtgagatatccacagacagggaacatactacatttttttcttctagactagcctctgtggactagttcatcctccataaggttgatatttttttcccaaagcctggatttgcattgcctagagccacattcacggtaggagatgggtcttcccagtgtgactggactcacttcttagcactccctcggtgggtgagttaggctggaatgaagggaggagccacctttgggattgcggtgctgccctgggcacctcacactgccttctcttcctgctgctcgctggtgcatgcttagaaaacccagtcagcttgttttgacctaaagcaaaaaccattattctctgagtttgtaggtaagcttccacccaaaatattgttgtgagaccttggatttggtgatcttgggctagctgcctaacttctttgggcttccatttctgctctatcaggtaaaggattgggacagatgatcttttatggctataaacatccagtgtgctccaaggccactgccaaatatacgcttcaacaacgctaggagtggtttgcatgatctcctaggcttgggaactctgggagcagggattgtctgttctgtgcctggtacatgggggtcatttaatacacgtctcgacaactgcatagcccttttgctccctgagctgagaggacagaggaggatgttaacagtcactgtctcaaaaagccctgagcaaatctgctctgttctcagcacctctcagcactgcctccttcatgagtccctgctgggtgggtagggggctaattaagcttgagtttcaagaacttgtctacaaatccacttcaagggctcacatgcaaatcaggccctgctggcagccattaccatctcccacctgcagcccaggccttagaggccaggattcacaagcagaacaacacctgccctcctctgagagctgtgctgcagcccagggccacgtggacagggtgctggtgcattctccagcaacactgttgagctctctagtttgcagaagagtccaagggtcctcacaaaacctgtgacaactgaacaatcccaccattcttatatgatatatataaccaccattccatatgtataattatgattgaaaccgaatatcattcctgattgcagagtctccaagatggtaatttctgtcttagtgtattttccactggtagttttgtttgttttcctgactaacgttatgaaacagtattactctcctgttacagatgtacacactgggatgcagagaggtgatctgacacaaggacagcccatggtcaagcccctttgacttctgtctgctgttgaaaaggatgtgcctccctttcactgagcctcattgcaatacttgtatagattctgtgcccctccctcccttccttccttcttccctgcctgcctgcctgccacaggtgtttaatgaacatcaactatgtgccaggggctgtggagtattctagaaatgaaacaaggttcctgctctgagtttttatgttgacgagaaggaaagggtgaataaacaaatacattaacaagaaaatatcaaggagcgataagagccctgataattatttaagatgagactcaggaggcaaatgtgacttgagcagcctgccccgcctcctgtgtgaagaaaggcaggaaaacattccagcaagagagaatccccactgttagaatctctgcatgttgtcattagctgcatagatctgcttgttgaaacatgaaccaaaactttcaatcttggtctgcttgccctggataaagtgcatttctgagtcttggaccacagcttgggaaattagcagaggcaaatgcaattgtctcttctaaagtctttttttttctttttttttttttttgagacagggtcttgctgtgacccaggatggactgcagtggtgccatcacagctcactgcaacctccgcctcctgggggcaagtgatcctcccacttcagcctcccgagtagctgggactacaggtgcccaccatacgcttggctaaattttgtatttttttgtagaaagggggttttgccatgttggccaggctggtcttgaacttgtgagttcaagccatccaactgcctcagcctcccaaattgctgggattacaagtatgagccactgcgcctggccctctcccagtcttgagaccacagtggttggaagctttaacagaaaacattatatgtgtgtcttcctcaggaaatgtattttgttaaaaatctgtaacatgaagggaatggtaggaaagagtaggctgcttttgcatttaaaacaatgttaggagtgaatcgctttcctggtgggttatgttagaatgaatctcaaaccctcactaatatctttcagaggaattttggcaaatagcagttgtttcttggcctaattgaagtcttggttaatttatcccaataacaataacattaccagtatttgtataacaaaaatggtttctgactgtgccagcgtgggacgaatgagactcatcacaatttgttttagggatggagatttagaagaatgggtggagaacattctaaatggaatctatggacagggtttttattcttagtgaattttgaagaagtgacgtaaaggaaacagtttcgtgtaagccctggctcctccctcaggggcagctggacaagtcgagcagatcctggaagtaaaaggcagccccggatttttatttctgttttccctttcaccctaacaaggccgtgctctcctgctcatctctctccactgcctggactcctctctctctgccttctctctctgtttcctcccccttctctgtgtgcttccacctcccgctgctccctgctctccctgtctccgttccccatcccttcttgctctttgctgctgaccagctgtgcaactctgtgcatctgagggactcctctggacgtcagctgccacatctgtgttattgaaggggacagacacgggattcctattatggccaacgcagactcaccctttctgcaggctcaccaaggaacgaccactcagggagagtgggtctgacatcctgagaatcaccatgacttccccaaaccagtgggacatccggggcctttgactgtggctgggctgcctctgacgggcgggaccctgacacccaccttagctgtgacagttgctccatgcagctagttcctgggcacctgtgcagttccttccacaggaggacattctgccctttgccttctttgagacatgggtgtcttgcttaaggggaccagtttcccccacgtgcctctctaccatcctttggctatagggtattttaaacatacagatttattttccttttctatttacagtttcctttgggtgagaacggagtgagttggttatgaccgggggacctgagtcacaccactttgattaatgccagctccaccacgcactagctgcatgactttggacaaatttcttactttcttgcagttctgtttacccattggaaaactgaaataataaaaagaacaaccttacgtggttggggagaagtagatacacggattcattacagtgcatggcacattttatttttatcttggttaaaaaatgcatagcatagaatttaccatgttaactgttttcaaatgttcagttcagtagtgtgaagtagatccacacagctggaaaccagatctccagtgcacggcacatttttatgctggaaatacctctgttagaaataaatccttggaattgatacatacacaaagccgtcactcatcacaaatgatggaactagaaagccaaggcctattggtgtctaagagtcagcctgcccatgctcacagacctgcctggaaaggttttgttttgtttagaattttctttttatcaccatttcttcattactggaagcctggctctttgcagacaaatcgatatctccaaggttaaacaatttatttttgtatatttttcaggagacatcgagtccctgtaatgcaagcaagttgctcatttcctgcttctccagttctgtcttccttgtcccctcttcccctgcctctctcctctcttctcttaccctctttgttatctcatcataatttcttcacagcccaatttctttctttctttctttttttttttgttttgagatggagtctcactctgtcacccaggctggagtacagtggcatgatctcggatcactgcaacctccgcctcccaggttcaagcaattctgcctcagcctcccgagtagctgggattgcaggcccctgcaacacgcgccccccacccctgtctaatttttgtatttttatttatttttaatattatattctatggagtcatttcccaactagcatgtcttatgcttgaattattctttatacttaatactgcccatcacataaaagacgttgtcacgaacccagtgttgttggcagaattttggctcctatgatctctgtcacctggtgtcacaccaatgggtatattacagtacctggcaaaagagactttgcagatggaattaaggttggaaatcgtcttggattctctaggtgggaccagtgtcatgatatgagcccttcaaagcaacagacgaggtcaaagcaagggaaggactcagtgtgcaactggtggcttaagggaggagaaggcctgagaaggggctggaccctggcaccagcatgagctcggaagcaggttttccccccaccccacccccagagcctccaggaagaagtgcagcactgctgaaactttgatctgcaccgccccactcccaggccctggacagaaaatacagccactctatgctggacctgggacctatagaactatagtgggtgttgccttaagatgctcagcttgcagcaatttgttttggccgcaacagagcactcctacacctaccattcactggcagataagagcttagaagcaaggctatttattcttactggagactggcttttttttttttttttgaggcggagtctcggtctgtcgcccaggctggagtgcagtggcacgatctcggctcactacaacctcagcctccagggtagctgggattacaggtgtccatcaccacacctgtctaacttttgtatttttagtagagacggagtttcgtcatcttggccaggctggtctcaaactcctgacctcaagtgacccacccacctcggcctcccaaagttctgggattacaggcatgagccaccatgcccagccagaggctggcttttttttgcttcaaatgctttatgaccaaaactgtctatgtgcagggtccccagctgaagtggatacatattttgtgttcatggaataggaggaaattagttggcctttcagaaatatgggacaagatttcttcttagaaatgtgccctaagcaagtgaattgagtaaaagtgtggattctgagtccctgctccttgcagaggactatctggaaatcggttgcattctcaggaaaataattcagaagtgcagtatcctgtggaccactgcatatttcctgaatcagtatctttgtggatatgggaaggggatgtatgtatatgtttggtgagcgcccaggcagtacatacaaacatttgaaacccactgctgtgctccagtgttttttaaacagctggttgagacccattgaatcatgaaatcagtgtagccagaccatcgtttaaaaaaattagaagtgcataggaaagaaaaggtaatgttatcagaatgtcttgcaacatggtaaggacaagtgtgtttggtgaaacttttgtttcaatgtgtgtgttttcactatatgtgtctgcgtatgtgtgtgtccagagtcaccatgtaaaatgagcaggaatatttcagaagcactgctcttgtctgatcttgcaaatctcaagcctttgtcctggactctccaatgcgctgggtctctgatcaaccctgccctgaccacctgcgtggcctgccttgccttatggcgaccctcggaagagtcgagcaggcagcgcgtgcctggggctttcagggacacacttccttccattcggggacctgtgagtatgtcagtggaaatcatttttttttctttttctttttttattttttgagacagggcctcagtctgtcgcccaggttacagtgtgatcctggctcactgcagtcttcatcttctgggctcaagccatcttcccacctcagcctcccaagtagctaggattacaggcacacaccaccacacctggctaacttttgtattttttgtagagatggagtctcgtcatgttgcccaggctggtcttgaactcctgggctcaagcgattctcccaactctcccttccaaagtgctgggtttacaggcatgagtcactgcacccagccaaaataattttctattcgctggggagtaaagttgtctttgcatctcccgcacagatatacacaagaaatataggcaggtgctggctacggatgcatagaaatggatggcttcaatacaaggtttttggttgatgtggaacaatattaccgcatagataaagaagccccttcaaaattagctttaccaatgagatatggtaaaaaaaagaagtataagtgatgaaaactaaagagacatatgactgtaagtgttaagacttgaaggaaataataaaagccaaactgcatctctgattttaaaatatgggagtcataataaatcaacagaaaggataaaggtatgctgaggaaagccaaagaggagtgaccactgttggtcaccaaactgctggctatttgcagaagggcctgaggccctgacctgagacttgtgctcaagtcagcatagtttgggctcattggaatatgtgatgctaacgatgtcccccagaagagtattttgttcctttacgcactttttaaaataatcatctgtgatatgaaaatttggactggtcttgaaggaatgagtcctctccttacccaggtttctttgtgatgtcaggcaatgatggtaataagaatggtactccagtactaggagtaatacggtactttgatagcgcactaatgcacagcattggcagaaggctcatggtggatgtgaaattaaacgcttcgtataacccataggcgatgttgttgtctttgtcatggacaggggagaaacatgaggcccagagaggtaaggtgagcactccctaatagtcagcattgggtgaggcaggaacattgtggccctgagtccctgagattcagggcttttcccatgaagccaacccactggtcactgagtggtttcactcctttcaccaaccaggatacttcagaaagcacttggggtgacccaaagctgggtccagatcaggggagtcggttgtaagttgtcatgacacttcatccttacagaaggtggaagttactcatttctgttcaatgagctttgaagaacaaaaggtcactgctaatttgaagattaaacctttataccaacaacatcctccaattactatagaaaatttagcatccaccatttgctcaggaagcaaagaagtcactgttgaacaaactctgaaataaccaaggcctccaggccccacacctcttttaaagtgctttcatgctgaccatctttttttttttttccttctatcttcagcccctaaccacaaagccaaaaaccacaagaaggcagaaaagtacaataaatgggttttctctacccatccccagcaattgtttcacagttttattaagttggggattcttggaaaaaaaaatcctgaaaaaaaaaaaacaattctagtttaggatccctctttgagtgctctgcaacataggcgagagcagtaaaaacacgttccattgaacacagagcctcagacatagacatctgtctgttggaaggaagtcactgactatggctttatgctgaaatacacagatcacgtttatataggattttatcatttgaaaacatccctgctcagagatgatcctgcctcattctgcaacagccttttgcagtttacatggaaggattcagattaggagggagaagttgaagagcctttagactagaggcagcaggaggaggaacagcctcagatgggggagagaggagaagttggcatgtccaccactagcaaagatctgggtgctgcttcaagatagaacccaagggaagtggcagggtcccaaggggaatgttgagtgaggctctcactgggggaggtcccagattcctggcccccagcccctccaaagggttatgagtcccaggatggcccagaagcaacagggctgacacaccttaaggagcaatgcaggctgaagaagttcctgccactggtgactcatcatcagaattcccctttccctgggctgtggctctgcataaactcacaggactgcagaccaggcctggaggagatgaccccagagaggaggaagactgagtgtgctgccagcctattagaactcagcattgcattcaaattctagttgctctaaagaaaattaggaaatgtgatatttcttgcacacctgaatttgtaggctacatgcagaacaaaggacaaaatgagagtccaagaaggaagtgcagtgctttaagggttgagtgaatggagactgaagggtatttaacgggccattggcatcaaattagaaagtatgggtcttagaatttcttttacattagaagactttgggctgaatattgatattctagggataaattcttgataccctaaaattcagccctcatacaaagcagtgattgtgatttcatgaatgttgtccctgagaaacaagtgtctggcatgagctccccatgtctggaccaccaagctgataccaataatggctgttgcttccttttcccctacatcaaaaccttaggtttgcttcaggcttatggccttggtcatcctaggagtcaccaacttgctatgagaagctggcctgattttgtgtcactttcatctttgtaaagtataaacacaacatgtgaagttgttaattttcagtgcactgccccattctgtagcgttctactttgtaaatgacattgagcatatacactttccaccattgtagtaagcccaacattcagtgaagacagatgcctccatttatttaaaaaaaatcaacacattattaattttaatgcaatttaagctaaaaatgaccgacaattcttggtttaccaacaacctcttttaaaaattgagactctcataagaggatttcggtttaaaaatgttgaaaggtctttttgtatagaaacagaatgaagtacaggatatatttaaaatgtggctaattaacaaaatatttgtggtggctcatgcctgtgatctaagcactttgagaagctgaggcaagtggatcacctgaagccaggagttcaagaccagcctggcaaacatggtgaaacctcgtctctactaaaaacacaaaaattagccaggcatggtagtgcgcacctataatctcagctactcgggaggctgaggcataagaatcgcatgaacccgggaggtggaggctgcagtgagctgagattgcaccactgcactccagcctgggcaacaacccgggagacagatagatagatagatagattctctctctcaaaatatatatataaatatatatatatgtataaatatatatatctatatataatatataatatatatacacatttatatattatatatagatatatatttatataatgttatataaatagatatagatatataaataaatatatataaatatatagagagtatatatatgtttacgtatatatttagagagaatatatatatatattcgagtttatattattatttttaagatttcaaaagccttcccttaaacacttagatccatgaatatcccgtttttttactaatgtgggcgatgaaacttcaaatgacttgggaaaagatattctaggaatgacaatctttttttaaaaaaattcttgctaggaagaagtatcagaaacctccatgttcttacccatattttcagtgattaacagtttcttgtgatgcaagttttctccacagtttgtttccagggttacaaatccatcatgcctaccttttcaaaatcacattaattcaagttcacattatttttatcagccatcaattaaatattaatcagcttttcttggtctttagcctataggtcttacttacaagactctttaaagaggaaatactagaaaccctgccagttcaatcccctggcttggaataattttgtcagcagtactgactcctgtagctatctgtgttgcttaacttgcgacttctcttaagtggaaagttgaagagctttaagagtattaacttgctttgtttccatattgacatgatcaacaggctacccacagatctgatgcatttcaatgcccaaacacaagagcatgcccctggaaaactgctgattctgagttccagtaaagctttaagctcctgagattatgaccatttctttattttggttttccactcgtagaaactgtctttcagataagagaggaacactactgtccagagagtggtgacaaggcatcatgggagaggtgcttaaaagtctccccaaccgccccatcatacttccttgcaagagccagctctggtgtcagaaattccctagtgttctgctggtttatgtaagacatgaccctctccaatgtgaatgcctctgtagagagagccaactgatgacggccttaaataaagatcctgaaactcctgtcctcttcattcagccagagaggagctgagctcacagccctaaactattcatttctaccaatggcagaaagtgtatagcccatttttatatgtttaatatgtaaggcagcataatattagtttatacacactcatttggaccccttatctctctgtgtgtgtttaatttgtttcttttgccattttaaaaacacttgaggtgtggtgcactcatgaaaatgcatctccctctttttttttttttttttttgagacaaagtctctgtcacccaggctggagtggttcagtggtgcaatcttggctcactgaaacctccgcctccctgttcaagtgattctcctgcctcagcctcatgagtagctgggattacaagcatgtgccaccacacccagctaatttttttatttttagtagagacggggtttggtttcaccatgttgatcaggctggtctcgaactcctgacctcatgatctgcctgctttggcatcccaaagtgctgagattacaggtgtgtgccaccgtgcctggccgaaaatgcatctcttaatggtcttgaggactgagccccatggctggcagtctgggctgtggatgtgtgatcctgcttgggtttaggaggatgaacaagctgaacttctcacttaggaaattgcaaaataccattgcacactgaaacctgtaaatttattttggaataattatggattgctaagggggacagaaattaaggccataactctacaaattgtaaccaccaggattgcctaggtaacagctccaagatctccagggctccaagaagaagcgtttatttctcagtcttgccacatgcccattgctgacctaccagggggctctgctgtccccctcctcatgctggttgccatgccagaggaaagagagctctggaaggttttatgtcggggctgttcaagctgctcatgccaaagggatgctgcttccttctagaacctgttgacaggtcacccagttccttctggccatagcaaccaggaaggataatgtaacatgtgcccgggggaggtgggctggaaatgtttggcagccagcactgctcacacacagatgtcaagagatgattttcactggacagaaaagccagcagcctttccggaggtgaagtatcctccgtcttcatgactaggaagaggctttgtgctgtgtctctcggtgtgctattaatatgtgagccagtgcattgccctaaccatcaactccatcctgcttcctcatcaagagaaaaatgcaaaaccacctgctgtgggatggagaagaccagcgcattcccgaggaggcactgctttcccttgccctcacagcctggcctttgaatattctcccagaaataggttcttggttctcattctcctttcctgagccctcctttctcacttctcttcccactctgtgccctggagtgccttcctgtaattcagagctggtgttcttttgggggatttctcttcatgattgagatgagactgtctaaggggctaatgtcacccatttcagaattcacttcccggataaggattcttcatagctgtgttaagattttgctgttgttgagtccccagctggctagtgctcttggcctccatcacttttctcttcctcctttcttgccccctttggtttcatgaagctgattttttctcaagtttcgactcttgcctctgagccaccttttcagtgcatgactttcactgccctaaaataacctatagcaagaaaatcccaaaagaacagtgttcattcactgcttctaagtgacaatcagaacttcttttaaagacagcatattattataattcattacaatgaaaaacagaaggtgcctgggtgagttgaagtaattgtttagttgtggctcctgatctttttaaaaggtctgcatgtgaactaaacactctaaatatgtccagtccctcctgtcaaattcctgtaagggcagaatcacctcggggagtggttcttccggagtggtgattgacatgcaaaatgctgcgcagagagcctcagcattcactagggcgtcttccttcctcccctcctcctttccttcctccatgactgaaggcttgcgtggttcccacaccctgctgggcactgatcaggttctaagatctgccttcaaggaacccacagcctcatggagagaacgacggacaattaggtcaccacaacaccggatagaaaccccacaggcgcagtcagtgcctgcctggctcacactttcataccctagagccaggactccaaaaccatgtgtccaatgaatcactcagcaccgggactgtcacaaaagtgagtgtaaagaactgtgggtcattccctctgcatcgtgcatttctctgacaggggccctgcactatttgcggaggcatctgtagatttatttcttaattgcctaaaccactctgaaatacctgtccattcccttagcataagattaagtggataatggccaaatctctatttttctgagtagccaaacttagcggtcagcatttagcctttatccacaaacatggataggaagccctgcccctgggcatggcagacgggcaggaccaaccaagaagcagggaccagcccaggcacagtgaggaccctcagcatcaggcaatgattttgagttgagataatggttagtgtctgtgtttctcagagcaggatatgctctttaatctaggatgcaaagcccatatgaggtaagaaaaagaatgtagaaccatttggaaaacacccatttttcccctgggaggctgagtaggtcagggggatccgctggcagggggtcctctccactcccctctgattcccagaggccgagaatgtcgtgttcagccattggttactctgtgctgcacggtgaagtctgtggttgttggtaagcagcgtaaaagccagggagtgtctgctgcaagaatccctgggcatcacgttgcttccgacactggtctgtgtgagtcccacagacgtcctagcagctgcaaggggcacacacctccgacctccgaccggcaggtatgaatgcttccaaagtgcccggagtgaacagattaaagcaattttggagggtgagtaaaaggatacaaatcaacttactgaacaaaaagaaaaagtttaatttctggaaaaaaaaaaaaaagtagctgacctgcagtctgagatatgctgagagatacacacattatcttacaaaatttctgcggggaggttcagtcgtgcctgtttgatgccttactaaatgttgggaatctaattttaactgatctgcagcagaagcaatcagcagccagctctgtgttgggtgtttactcagagcaaaagttttctgggaaaggcagtttagcatctgagccacggtgcgatggttagccatatttatgaccactcatgcatcaaccagcatagtctgatcttagcctctgggagccgatttaagtcttgaatgtgatggctaatagatagaattctgaaaatatgtgtatatatgttttccttcagactctctagtctctcagaagccctatctaactagaaggacaaaagaaaatctcagtctttgcattgtactgttaaagcattagaatgtactaaggcaattgtaatcacaaagcattcaaatgtatggtatgcattgtaggctattaacataatcctgtgtaatgagaagatcagcaccaagctagcctaatggcagacagcttctgggatttcaatttttgcctggattcacagaatagtaaaacctcttgggaattcattgcttttttttcagttgtcagaagctaggctctgtgcaacaagtaaagaattctttcctgaatagttattctacttgggattcagggagatggtaaatgtccacgctgggtatcaatatcagagtccgttccatcagtgcttagggtctagaaaggaatggatgatcctgaagccgatgttcagtgatccctcacacttgtaatgcagggctggaataacgtgatgggtaggtttccatcttggttgaacattttatgattctatggttttctttcaatgctaggattgtcatcctgatcgttagaaatcactttagtagatgaataaacagcaagcagtgagcgcatctaatagatttctgacaatagatcgacagcttttctttctctctgttgctctaagtcatttgagaaaagcctggggttacagatattctttgtcaattacttctggaatccccatatctactcttttaggcttttaaagatgagataatatgagtatgctagtaattttgaaattacttcttaagcaaggttctgcattcactgggtagaaccaaaataatgcctttccaaattaaagcatgtgtatagtatataagcgggtatttcttctgagtaagcaagaagatattaaaaacattgaaatgatggaactctgcagaagaaccatatgacgcatgcacaactctaggctgcattgggaaaaccagccatatttgggtttgggattagcctcttggttttgtgcaagttgcttagtgccctgtattacccatcagtgaagtgagtggttcctcccagctctgagatttcatccgaacagcatggaaaacagtagatcattttcaccaaatatctgtgtagataggactgggaacatctgattaaatgtgttgagtgtcacattttctagatgttagaggactctgacaatgtcttgttgaaatcatacttgggtctggctctggactctaaaaagctcttccttaatgacatcagttgtgatggatcagagtcacttgtagatatggtgatgaacaaaagactagtttttattttctctttcacagatgaaaccttattttagccactgacatctccgaatgatctgaaaatgtattgcatacaacacctcaaagtttcagatggacactccctcagttgtatttggaagggaggccccaggggccccttggcatcctctgagagatgttcctgcagacgcacaatgcacacaagtgcacagaggcaactgacttggggtcccaagctagtagcacacaggcatggcctgagtactcagaggaggactccggtggatatgagcagacacccagggtttcacttgtcaccaacacagtccagatgatgaagcaaatactcaatactccaaagaattccttaattatttaggaaatttaaatgggtgatataattactcggttgtctcaattctgaattattcattctgtttttaatggtagtttgatgctagtaactccaggctattattaataattttttaaaaaatcagaagtagattagaaaacagtttcagaggaaggatttaaaagcctcttaatggaggagtggctatgcggcattgcattcaaacagccacagctgaaggctgactgggcttcctccaggctgtcctccttcctgagccagttcccgtttggagtctgggctggagggagctcctggcagtgccatgactcagtctggtgaaaaagcctgtgtgtgttcaggctgactttgaaggaagcacctctaatgatctgcagccagggtggctttgaagatggtaagcatagaatttcaagaactggactttgggtactcgtatgaaatggaacattattataccactaatttgttctctttaaaaaacagtgagagtcttctcatggttttggtagtctctatttatttatatatttttattggtagcaagtgggaataagagcacagttgtttaaacaaacccaagaccattctacttgctgtggctggaaagtgaagagtattggaatcactgttttaagtggctttgctgtttagactgaatgtgcacgagagccaaatgactatttgatttcactagaaaaatctgtaaatctggttattggatactgtataaagccatttaattccacaaatgttagcccacagaaatctgtgcactggaagagctcctttaaatttacaacagcaagaaaaataggtttgctttcctatatactctctactgttagttacaatgacatgaaacaacccaagtttgaatatttaagagtagccacaatcacgaagggcagtgtgatagaaccgagcaatgaacaggatgtaagaaatcctggtttaatcctatctttcctatggttttgcccaaagtggtcacttctcctccctaagcttcagtttttctcacctgtaaaattggggaagagggtgtagatgaaatcagcatgattctgcatgtcagtagtacattattatctcctagaaagctttaaaaaaaaaacttctgatgccgagactctaacccactctaattaagtcagagacacaatggatgaggcccgggatatcaatacatgctcaataaagctcaccaggtcattctaatgggcatctatctaaagttgagaacagtagaaccgtctgaaggtctcttctggctccaacattccgtacctgaagatgctaatggctctttctcaatgtcagagcacgatgcagatcgtcttgtggtcacggtggttctcttgactcttctggtcacgcgtaaagaccgggagtggaaggcagcacctcagcagatccaaaggccatgaacaccccacagtgacttcccaagctagagactgtgagtgtacttggtgtggacaaggcattcgggaaccactgaattaaatgggatatttttattcttaagagcagtgaactctactttcaaggggatgaaacaagtgaaaaaaatactttcccccccaaatatatttgtcttggctacaccgaggtctaatcagattttaggtatacaaagattaataagacacagtccttatcttaataagacatagtccttatcttaaattaatttacaatctagtaggggtgagggacaaattacaatctagtgggggtgagagacaaatagtaactgtgtaatgtgggggtctctaagtctgatattgcttagctatgcagttttctagtctcagaaacttggctaatgaattcaaaactggaaggaggacccctaaccctgtcatttgcccagttaaggtagttgagttttgcgagtgagcttttcattatgctttccatacatatttctttgaaacacaaaggtatctaataaacccacacaaccccacacctgtacacacacagactctggtattgcgaagtgtttacactgatgtgcaacaagcctctatgtacttaaatatgcaaacctatatttacatatttcgataaaagaacaaaatacaataggatacttcatcagtcatgacacaaaggtgaaaaccactgttaactacttgtgaacctcttattctatccttaagcatctggaggcagcttgtgtattagaattattgagcctccgtgtcccagatttgtgtcagaacctatccttatccaagacttcttccgaccagggagagaaacaatagcctgggtgtttgtgttctttgcagctctgaccaggtaagactagttgtctataggtctccttcttgcgttctgtgggtctccctgaaaccattttctgcaggttgttaggaagtagggaaggctattttaaaattgctaatccaaagaggaggtaagatgagatcgtgatacctttttccccaagggactaaccacacaaccaaccaaccaggatagtttagtagaagaagcatcaacagtgctacaaatcagaatttgaatttgtatctttccacaacctagctatgtttgcttaggcaaatttcaacctgcctgaatcagatttcctccaatttaagatgaagctggtaatacccctacgtagtgtttgggggtgaagattaaatttaatattaatactgtttatacagcagctattaaaataactagcacatagtagatgttcagttagtggtgtccaaggtggctgataactgtcatgggagactgagtgcaccacttagtaagatgtttgttccgccaactcagtctctatgaagtagctctgtgtgatgtgggagaggtcatggggttgcagtggtacatttggaaaaagaaaaaatactacctcttagactcttaatggagtaaatggtgtcattgcgtagattctcattagccagttctcccttccctctcatgccgtgtctctggggttgagaccagcgaggctatctttgtatttgaatctctctttgtggtctggcttgtgtttcagtgtatatctttccacacaaaccagatcaactgctttcagctctgggaggaaaacaaagaaacaaaatgtgatgcagtcaaacaatttaatttctcaaagctttatgattcaaataaccaacaacattttacaatgagtcattttgatggccagtaacaccacccatggcttcttctttggccttaaataccgtccttttagagaacgttcttagtttctttttaaccaacagtcaaaaattattaatttggctctttattcatgaacattaaaagctggaagttaataaatattttatgattgtaaagctccaatgcatatctgattgatatggagggataaagaattgaaggcaagagaggcctcctctttccagaatttgcaaaatcaatataacttgggctttcactgatatactaggtgcatgactaacattggctagagcaggtgctgtctgatggaatggcgctgccaggaaaccctgatgctgccccggggaggtctccaggtgagtttgatcattgcatctttccctagtcttccaggtgaggttggctagaatacccaggggaggaaaagagagcgtttatataacaccaccagcccctctagtaatgtcaagatttgagagaagtatctagtagctcttccttctcaaaaggtgatgggttcctgggctgcaatgtatttttgaaaaatcatatctcaatcttggaataataagcaggcaagtctgtcagttaaaaggtacttaagtatatgatttaattcatattatgtaatttttttctgcaaatatgttcaggaactcagctgcagtgttggtttttctttaaagatttttttccctttcccctagtgaaccagaacagattcttggagcttgctattgattacgcagatggatgggtctttctgagctaggaggagagaactaggataaatagagtccattttttttccaaaagcctgaaaagcccatgaattcacctggtattctggcaagagctgttacttcttaaagcaaaaagggcattgaataggtttttcataggatggcccttcaaataactactcctagccaacaaaatattttagaagcttgctttgccatgtgctcttgtaggaacctagaaaatttccattatcagctgttttcaaagaaaatatttattttctttttattttataaaaggaaaagttaattcatgaaatataaataaattctcagattggctattatttgcttaatagccaataataaaagagcaactgctattgattgcagagaaagtcagtgaacaactttgtgaatcaggggtctgttgatagcttattgttaggggagtaatttgcgaggttgagatcctatgctctgactgctgatgccattttctgcaaacgttgcctgagccaagtcactgactggcagggcttgtgtatgtgaaatacaaacatacttgtaagatttataaacgattacatggtcacgggcatcttaatggaaagaagactgctaatcattgacattgaatatgtagagaacacttcttttgtaggcagatagacttattaaggtatcttgagtagttctttaatcaccctgtctctgttgccttatttataaaatagtgataagattacttaacctgttaaaattttgtgagaaataaatgagatcataagtgcaatgtgcgcacacaaggcctgtcacttctgaaaaaaatgttggtttcccttttccctctgtgcagaccagcctgcatttaccctttagctgaagcatctaggccaaggatgtgtgtgctcagtgcatagctattgaatgaggaatgggtagaagattgattgaatgaatgaatgaagctagcttatgttcaataaatacctacattagcatttatgggtgaaccctgaatcagttaggaatgcgtcgagtctgtttctaaccaggctgcctcattactgatattaacatttatattccctgaaagcatcagggaatcaggaaaagattctttcccatgttgtttctgttcttacctggccttctttagggacatgaacttcaggtagttctggctattagccactgtacatagacattacatatgcattgtttgttattctcctttgaatttaagattgctctttgactaagaaagtagagtgtttccactctataatttatcgactaagaaaaagaggcaggagaaaaaaaaccacacacaagacaaacatttaacctaaggctttcaggggacaagtgctggtggatttctgtctcttaatgcttgagtattttcctgttttagctgcacgagtgatgaaagtgaggtgaagactgatttaaaggcaccttttagttcaagatgccttgtcttggcaaagattttaagatgaaacaaggtctccgactgagcaggcagttatcattaaatttcgttttcccattgaatttccattttttcccaattgtacaacgtcttgatagcatcactgattcctcatgaaaatacatattttctacttgataaagccacctacaaataacttctcccatcctccaaatcccacaaatgtgatccctactacaattagctaacacctagtcactagttaatctggtagaccttccagttccttcactgcctcttggttccaggtattgcaccagcactgcagaggcaattagggcagaggccttaataagaaggcctccactgaacttaaagccaggcatagggaattcgtgaaagaaaccatagtaaggtgtgagaattgccagattaagacagggataaagtactcttgaaatatccaaacagaacacttacttttgcccagaaggcagaagcttgaggaaggccacaagaaggagatatttcaattagatgcttttataaatgaattttaaaaatccccatatgggtcaaatgaattctaagtgaagaaaacagtgtggtctgtggaatagaaatacggaattttatagaatctcgtgcaaacaggaattattttactccagctagtaaagcaggtgtttgaagcaggtggcggggagttggcatgagggtggccgtcagtgaggccagagaagaccccaggccaggtggaacatgtccctgttgtacggaagtccagagctagtgagctgatgctcatgcatcatttgaaatagtaaacatggaaattaaggcatgtgctgttcagaaggctcagtaaataacatgtggagttaatgcttcctgtatacatgtagacttaggtaagcaaagcctgaggttcttgggccttttcacttgctattgccatggaagagccaacaaactatctctctcagttccagcagtcctggttcatggctatttacatgcaaatgtcaacaccagattgaaaacatcagagtgattttgctataaataaaaagtacattagacttttagattttctttgggatctgttagtgagcattacctgtgcgtgcagacctgtacaagacatcttggaagtgataggaaaaaacagcattctcgtgtgtagtagatagattcctattttcacacccttctctagatatctgtcagatgatcttatactcatatttttgaggaagcaagagtgggatatctgttagagccccatttgggcaaagagtaaatagaggggcacagtttttatggaagcctggaatgatggattacattttaataaggagagaaatttggttgcagggatacgaataagcaggttgaatggaggggcagactgggaggctgagtctcaggaccgcagggccagagcagcacctgcaggtgagaggtctgcagagaatggcagcatgtttggagtgcatgtgaggcaggggcatgggggcttagagtgctcctcttctcatggtgggctcacatatgtgatgtctacttgtgtttggaagcctgggtgacaggtagaccacctgtgaaggatggggaaagagattcctcactttagtagcattatcaagttcaagcaccagtatggaaataggaagaaagcaaaagtatgtactcctcccggctaagcaggttgtgagaatcccagcatccttgcacaccctgggatgcgctcaccacagaggggtgtgcgctggtctcaagggaaaaacagaagcaggcctttttgaattgaagtgcaattggtgtaatataggcaaaatagcaactcttttcctaaaggaacatatcgtgcccaattttaattagctctgatgaagtctaggaaaatgggtgactcgtcagagaagctgttaaacttcagagaaaaactgcctatagccccaaggtattccttactttgacaaaattcttatttttccttaagtgtttgtcactgtgaaacccgtcccatttccaggtgccgtcactgttggtatagcttgaaaaagcaacacacttcctatggtaagggcagcttatgggtgtttgcaggtgcaaggcaaagagacacaaaaatctagatgtcagaaagaaaatataaccagggggtgaaatagaagggaattatcataaaaatcaagatgaattggtaatgaatcagatgcatatttttttctctttttgaacagttttattgagatattaatggcatacaacaaattgcacatattttaaagtgcacacattaataagctttggtgtatgtatacatccagaaactcacccctcaatcaagatgctgaatgtgtgtgtctctcctgagagtttcctccacgccctctgtgacacctcacctcgctcctcccaggcagccagagatgccctttctgccatggaatgtttgtgtgcatttcctagaacgatacataaatggaaccatataggatgaattctttcgttgtcagacttccttctttatcccttccaataggcgtatagcaatatctcattgtggtttcgttcgcacttgcctagtgagaaatgttgttgaaaagtttttcgtggacttattcgtctctcctctgtcttctttggtaaaatacctggtcaaatccattgtcagttgtataattggattttgtcttgttttattttgttaccatttaattttgagagtttcaagaaatatattctggatacaattcctttgacaaatatatcgttggcaaatattttctctcactctagctcttcttttctttcattctcttaacagtatcattagaaaataaaattcctcattttgatgacgtccagtttgccagttggttctcttatagattatgcttttggtgactgcctaggaaatctctgcctagtagagagggtcacaaggttctcttctatcttttttttctagaagttttaacatttaggtctgtggttcattttgagataattgtatattgtatgaagtacgggttgaagttcattttttctgcatatggctatctagtcattccaataccatttctcgaaaagacgatccttcctccttgaaatatggcagtaacaaattatagcacatgtgatataaatgacttgcaaagccacacttccaacctgcattaggaatggacggttacaagggccgctccaggagcccacctggaggaaaatggaaactgccattggctggcagcctgttgggtaagaatggaaactgccgttggctggcagcctgttgggtaagaatggaaactgccattggccggcagcctgttgggtaagaatggaaactgccattggccggcagcctgttgggtaaaccgcatcaggctgcattcacggatgctcttctgtggcactgatgggatgactccaggaagtctatggggaagtaccacaaaatgtggaggaagatggcactagacacctgaggagggaccacatgacctccatccaggtgccaaataattacagttgagatgatttccctgcctctactaacccaaattcacccaaattcattgtccacgttggtgttaggtgatatttccaaaaaattctgttatgccactcctttgaaaatttcctaggaacctcaggtaggtccttcttcttcagagttctagaggacagcagtgtgtccttgcactccctgccatcttccagcaggaccctgtgctcagccctgctttccacctgtgcctcgttcttacatgccttgtgtgagggatgtggcttttccctttttcggtttggcaaacaccttctcccttttcaagaccctctctgaaaacacctcatgtactcctgttggtattagcccctcttactttgtgccaccagatcagtttctgtctctaaatatcattttcgctccatcggatagaataactgttcctcctctcctctctgttctgtgtttccccacagagctgtgatggatggaggcctgtttgctgttagatctgctacagctggaatgtaatcttgcttggagtaagaacttacaaatgggccgggcacggtggctcatgcctgtaatcccagcactttgggaggcagaggcgagtggatcacttgaggtcaggagttggagaccagcctggccaacatggtgaaaccctgtctctactaaaaatacaaaaattagctgggcacgttggttcacacctgtaatccaagctattcaggaggctgcagcagaagaatcccttgaacccaggaggtggaggttgcagtgagctgagattgtgccgctgcactccagcctgggtgacagagcaagactctgtctcaaaaaacaaaacaaaactcacaaatgttcatttagtgaatgagtaaatgaattcagtgaatttctgtgttattcatactcatcctactttcatggagtttttatgaaaaggatgatgaccttcagccatggggagcattgcactgcctccttccaaggaccacctgggctccctggccatgagccagttgccccaaaggcatttgacttagattaacctgaaaacatcgatgtcatcatccctcagccctgctcagaaagctgcagggagccttcaccctttcaggaccgaggccaagctccccaggctggctttatacatcctctaacagaagctggccctatcccgtttccacttaattgactcttccccatgggatactctccttaattaaaattcatctctaccccctaataagcgtatgtgttcctacctccatgactttgcaccctgaaatgctctcagattccagtaaaatctcccttctcctctttaatctccaagtttctatgttttggggctctgagtctcttctccccataaagtctccctttctgaatttccagcctcactgcccactgaacatctaaccagatactgctttgtgtattgagtttgatggtataattagatggtgtatatttctgccacccacggcacagcctggtgaattgcaatctttattcattgatattgtgatagcagtgaacttgggtgtggggaaagtttaatgaaggtcaagcagaagatatgtaaagctctaaatacagagagtgatgatttattcagagaaataagagaatccatggggaataccagactctagcttccttgtggacaagaagcattcctgtgcctctgtgtgctctgtgctccttctccctaactagatccccacccttgccctagcttggtgcactgataccatacgtcgatgcagacactaaagagatgacttccacctcctcacaaatattcaggtagaagaccttccctcggaacacccggtcatcagagagtgttcctgatttcgcttttgcaaacaagaggtagtccagcttggaagaacatccagcgccttccctgaaattcatctgttctccactttccactcttgactgtcataacaaaggacagttgtaggtggtgcccagtgacccaactcagtcagctttatctattggcaataaggtagtattgacatatcaatatttccttgccaagatgctcatttgttcttaataagaatcaataatgttcaattaatatagattatgtcactaagtagttaatttagaatgtcgttgctttgcagttcatatcctaacccacctgatcctaacagcatccacctaggagcccagaccgttgggaaggagaagagcagaaaacctaactggtccacctggaagacctagaatttcattccagcaggagcggcccacccaggaaagggcctccctcccacagcagctgctgggaatcactctctttgatgacatcattgtcatctgggcagggagcagaaccattttggggtttcccatccattcagtgctcccactgaggtcttggagtatggcccagatggctgtagatgtgcaaacttacgatcatcctggagcacggggccctgtgtcatatggatcctgcttgatgtgtagatagtgcattattttcctacttgagctctttccttttccaggtacatagacagggttgccttgaggcttagtcacccttcgcccattctgtcttactactacagagggtgagagactggacaaaggggccctcagtgtaattttcacttcacatattttattattattttttttttgagatagggtctcactctgtcgcccaggctggagtgcagtggcgtgatctctactcactgcaacctccacctcctgggttcaagtgattctcgtgcctcagcctcccaagtagctggaattgcaggtgtgtgccaccacacctggctcatttttttgtattcttagtagagatggagtttcaccatgttggccaggctggtcttgaactcctgacttcaaatgatctgcccgcctcggccacccaaagtgctgggattacaggcgtgagccactgcacccggcctcacttcacatattttaaatttattccagtagtctaagcattatgcaactctggttagataatgaaggtcatgatacacctagaaggttacagatttcaactggattaaccattgttatacaaacatatgtgcatgtggatatcagaggattcagagcctctctcctctgttttgtaaattgaccttcagtctctcatcttaggaatgactcttggccttggatgagggcctgacgagggtgggttgagttggtaaaacccggctgtgttagtttccagtccatctgaacccacagccccttttcctggctttccctgctatagcccatgaacacaatcacagtttctgttgatcatcgttatggtcctcccaaatccttcacctgggctattggtttactagggttttttttttttggtggatttgcccaaatgtggggacacctggcaggagacagcagctggggttcctcgaggctgcttggagccctggcccctgagtcaagtcctcacgttcccttttatttccttctcccctaattgcaagtcgtcaggagtttcaaatgcccaccaacatttggagaaggcttgtgggctgtttgcaggctattcagccccaaaggctgtacggagataggtgtgggttatcctaagcgtccctgctcctcatgttgtcactcatccattttcagtaggcgctgctcctaaaatgcacgttaatattgatgctgtttcatccgggttcttttcctttctacattgcctcacctggtttccactattccctagtaactaggtaggagtcatttttttagatgaataattgatttgcttaagggactttgggcaaacttaattggtagctgagttagaagtacacattttgttcatttatttgcccgtcctttagatattcatgaagaatttgcatagaagcctagcactgagtttataataaaaattaacctcatggcatctatactctcagccacttttttttttttctttttttttgagatggagtcttgctcagtcaccaaggctagagtgcagtggtgtgatcctggctcactgcaaggtccgcctcctgggttcaagtgattctcctgcctcagccttctgagtagctgagattacaggcacacaccaccatgcccagcttttttgtgcttttagtagagacaggttttcgccatgttggtcaggctagtgtctaactcctgacctcaagtgatccgcctgcctcagcctcccaaagtgctgggattacaggcgtgagccaccatgccctgctttctcagctactttaaaacaaataacaacaaaaaaatctcctgattgtcagtgcagagccccgcccgtaatgcctggactcacaggctgctgggcttagcagtctcctcaaccccagctgcacaatggaattactcggagcttttaagaaagaaagaaataataataccaattcaaaatcaaacacggaacacatacatcggtcatcagtcacataccatagattcttatttaatcagtccagggtgtagcttggctttggaaggctttttctttcctggctcctttttttttaaacaattttttattgatgcataatcaatgcatatagttttggggtacatgtgataattaagtacattcatataatttgtaaagagcaaatcagagtacttaggatcttcattaccttaaatatttgtctttatgctaggaacattcaaatgattcccttctcgctattttgaaatgcacagtagatgagtgtatgctgcagccaccctgctgatctatcgaacgctagtgtgcagctgagggtgagaaccgccgggtggagattggaggagacctgagtctttaataaacactgagccgctggggaaaaggtttgaggggcatttgctaacacaaatgctaaaggtcagtactaaaaactactcaggccattcttaggcatttttgtcttagaaaatgtcaaaacagctgtgacctcatgatttctgtctcgtgaggactctgaagaatgccttagtgctcctgaattaggttgtaaatattgtacttttttctcttgagttttctttggaagaatagtgaatgattaaaagaaaaccaaagcagtactattattttagaatacggaaatgcaaggtagcaaagtgtctaacacctagaaagttagccccgcctggacaccagctgtgaagctctgtattaattgaacaaatgctgtccaagaaagcaaaacttcctaatctcttctgatggtcctcaatataagattagtatagaatcttcttagaattggtttcctttaaaaaaaaaaattgtgggcttctcttccccatcaaaatgacatccctttgagattaatgcaggaagcagagggcacggtggaacttgtctcgctgaatattctgacgtggtcaagtttcctaatcaacagcagagatacaaacttgcattatagttgtgggtggtggggaaaggattgcctttttttgttgttgtttttttttgagatggagtttccctcctgtcccccaggctggaatgcagtggtgcgatctcggctaactgcaacctccgcctcctggattcaagaaattttcctgcctcagcctgccgagtagctgggattacaggcacctgccaccatgcccagctaattttttgtatttgtagtagagacagggtttcaccatgttggccaagctagtcttgaactcctgacctcaggtgatccacccaccttggcctcccaaagtgctgggattacagatgtgagccaccacgcctgaccaggattgtcctgtaaaagtgaatttttctaggcaattgaagattgttaaaagtgggttaaggcttatgcctacctaaaacattcattccaattagggcctcatccacatttaaattccagattctgaaaacccttcactcctaaataagaaagtattggggcagcaggtcccacgccggactgtggaggttggctacgtgcagtgaatgagtcatttctgtaccctctagtgtatgtgtaaggtacagctgcagatagatccataggaaacagggactccaagaatagcagttagtaaatccgtgatccgtgtgtcatggttctattgaaaggaaagtgtaaccacatcagtgggtctgcataccattgaaaagagtttctcaatcaaaaacctaaacacatgtcctgaaaccatcacttaagcactctgagatcttgatccaattacctaaacttcctagatctgttttttaattttttttgttaaatcattgcaataattcttgtatcacagagttactccagagattaaataaggcagcgcatctcaaacacttaccagtttttgttaaattaggacctttttcacccactacagttagtagtacctaaaagtggagctacgactagttttcttggagtgagttttgggaatttaaataagtaaatcgtgtgatggagtttggaagtgataaagcactatataaaatgctcatgcatttccccatttcccaaatgtccatggcatgagtcgtgcattccagatgcctggtgtgttctgggaatgcaaggctggccatgcgctgggtctctcctcatagggtttacagtcagttaacagcaatgcacacaaaaggatgtattgaaatagatccattggaggagtaaaaatacggtgacaataaggggacagagaagaaaacagacaaccatggccagctcctaccggaacagtggtaaggatgccgaacacattcatacatttctgtgaaaatgcaagcccttccatttcattttggttagtaataatcatatattttggccaggcttccctcccccaatttcctacggctctgcacttgacattcaccaaaaccctgttagtttcccccaaaccggacgtgattccactcctccatccttctgcccctttccgagcagcttccttcagggctcacccacacctggaattcagcaccagctattacatctgcatgtcggctcctgtgaacccgtcatcccctcctactacaggccggggccactgggccctgttagttcagggcccctccattccccagaatcttcttccactcacaacagggcaagggtttttaacatgcctccttccttccatgccttgagcttcttgcaggcaaataacaaaggcattttgtctgagtccccagagctaagcacagaacctggactatattaggcctttaatttttttccaaatgtcagctaacaggcacaggcatgcatacatacacacgaagcattttatttttttacctgatggggacacaggccagggtttgacttaggagtacataataaggattgacaatcaggacattaaagcagataactttgggttcaagttctgattttgccgcttactaggtggtgaccttgaataaattacttaaattaagattttcccactcacttgaaaatggggataataaaaatcataacaatacattttggagagtattaaatacggaaatgagctaaagttagctcatgcccggcatataatgtttgcagctagcatttagagtgcatggggctgctgatgtgttgatgcctgaagttgcgcaaatacaggtgggtagtggaatacggaaacaatgatcccataaaccaggcccaaagccccatcactgaaggaatgcttaccttagcctgaattttccagtatcctctacatgccacaggcagagccaccacccagagttgaagccatctgaaggtgacatgctgcagccttgtcctcgcaggtcattcttcagcctcctgacctctgctcagaagcctgtctgtgcttacggactgggctctgcacagctgtcacatcctatcactgcccctccaggtttgcagtcaaagaccacagcagagatgaggcataatgaaggacagacacacccaactgagcaccaagcaagcgacatatcctaatacatatgtgcgatgtgtgcatgtaagggcaggagagcaggagagaattggaggaaatagctgcaaccaaaagtgaagaaataataagacacctggaaagaggcctctctcttctgatctgtgaggccgtagtgcagtggaagcgcctgatctagagagaggcaggcggatatttgtccaaactgcagctcacacctgtaaccccgtttccctcctcaagtcgtctacatttactttgcctcagtttcttataagaagatagaggcagtaacatctatttttgtgtgtttttgtgaaaatgacatattatagagaaagagtctgttaaaaatagaagtgcttaataaatagttgctattgtaagtggatgtcagaggagctgttacaatatatcccagaaagtgagccctgggaaggcgccgattttccatagcaatcctgtttctgctttacagttgcttcctcttacgtgcatttacctgcctggtcatcctgcagggcagtgccacctgcgcagtggtgtgttgcatccaggaacaatgtccacatgatcagtgtcaggcacagagtggcatgggcatcctcaccattctgtctccagtcccatccgtggacaaaatgccccctggaaagttgaacagagattgcttcaaatgggccaaatatgcattagtgaggaactaaactgctttgacagctcctgtgtctcctggatgggaagtggggagggagtcatggagttttaatctcatcctctttgtggcactgggcacgccactcaagatccctgcttatttccagcttatagcatagaatgagaagccattcacccttgtgtagagtgatgctgggaagaattaattattcaatgacttaagggtgcttctgatatcaaaagagcccattatcatcatcggcctcctctccccagtgtgaacacacggcaaacctgagactcattggaagggacgctgctcagacctgcgagccccatttccatgggtaggtgaaatgtctcatggctgccgacacccttgcggcaggtcctgggcgtggttaagtagggggaaagtgtatttcttttctgtggcaagatttattctgtaggagagctcatactttggaagcagcaataacctaggactgctcttaactagcttgatgaccttgtgtgtgtgtgtgtctgtacgtgtgtgagtatgtgtacctgcatgtgtttataccgtatatatggatatatgtgtactccggaactcataatatatacagttataaccattgttcaatcataagctgaatatgcatgagtcactctttcctgcactgaactccattttgtctgtcacaggcgttagatgacagcttagatcatagcctgctccaatctttacattttaataagcaccttttttcaatgccactctgatacaccctctggtccttcattagtcattgctgatattatttctctctaagtgcttcttcctccattttaaagaacaacttcgatgtggttttttttttctgttttttaaattaaactttgtattttgagataattgcagattcacatgcacttacaggaaataatacagagagagcccttgtaccctttccccagtttcctccagtggtaacacccaggacattgacatggatgtagtcatgatacaggacatttctgtcctcacaggacccctcctgttgtctttatgaccactccctccaagccctacccatccagaaccctgacaaccactgatccattctcatttctataatcttgtcatttcatgtagttaaataaatggagccataggtgtgtgaccttttgggattggcttttttcctcttggcatatttctctggggatcatgtatatacactgatatggtttcaatcttggaggaatcctgattctgaaatcctagagtccaaatctgatgatttcagggctgaacagttcccttctttgagtgatgaggacctgaaggctgagagacctgaggtgtcatgcccagggatcacccatggcacagcctgagctcacagcagagatccggcctccaggcccggagcactcctccgccatgaggtcttttacagctcagactgggcaaagctctttttaattccaccaaacctagaattgttaaaaaaaaaaaaaaattaattaattaattaactaaaaacgctcaagatgccctcttactgccagccacaaaggggattctcagccatcccagcctttgtgggcactggagcagccgtggcctctcttggtcctgcctgtgtgtgcaggagcaggcacaagtgggctcaggctgatgcccccagaccaccctcggcctctgacccttgcctgaggctggcctccacaccatgatgccatccaaggaaaggcatctccttaatgcctctgagagttccatttgtaaacatttttgaatgaaggtctctaaagaagcagccaaagggcaggatgtcccacaacacaaaataagacatcctccttatgctgtctctgaccaaagtcctcatgctcacacagctggcccttccctctcttctcttcttctcttccttcccctcaaagaatatcccagcctctatcaaccagcaccgtggctctcatcaagatctttgccggtcctcggcccttgttctccgaacctctgtgctctcttacataaattagcaacctcctctggcatctctaagcctgtgcaccacccattccccttgtcccatagcacaggcagcacagaggcatggcatgccagagaaagcaaagaagggagaagccttaaattcctgtccttgaatatgctcttgccccagacatattgctcatcgggggtcataacagctcgcaaagcaaccttttcacgtacctgagaaactctcccaacgtgtccaagcccgtatagctgagtcacttgacctttcttcactatgacctcacctacctgggccctcaccaatccatccagataattgtaagattgtataaagttgaccgctttctcaatgcattctcttttctcatcaagatatcagaaatctttgacatgccctagaaaaaaatgcatgtgatacggggttttactgtagagcgatggaaatgttttggaactggatggaagtggtggctgcacaatgctgggaatgtactaaatagatgacatggaattgttcactttgaaatggttaatgctgtgtgatgtgaatttcacctgcatacattatttttaaatgcgtatggggtcacttccaaggtgaagtgcccagtcttctttcagacatgaggtgtagctagagcattcatgaaggtatgcaaggaagggctgagatgagcagcaaggggtggaaaggaaagggtaccgaagtgctgctgtgctccacgctggccccttacatagctggagacacaaaagtggggcctttgcgtatccagattcgaagaatttgatgagggcattatcaagatgaaaatgtggaatattgttgttggcaaagccacattaacacacccacatagcacacatataaaagttctaatgactgtctggtgctttaaaatccagggcttaatacaagcaactcaagttaaccaatttaactgtgaaaacccaatcataggcatttcctgacattttgaatttgcaattgtaatgccgttggtgtccatgtagtaaaaaagtgcaatatttggaggatgcgtattttacttttagattttatatatttatcaattggcatgatcttaaaaaaaatctagcattaacaccaaacatatacaagtgttgtatttaatgtctgtgcacctaaatcagaccagtcagaccacttcacctgttgggctctccaaagcttttcagaaacacagcttatcattcacggacacctctgaagaccagaggcattgtctgctgaggctgcatagttgcttagggcctgaaaactttgtatggtagtttgtaatttgcaatgaatcagttacagccagaattaagatgattttcactctaactacaaaacaagtttgactgtaaacaaacctagagcaatatacagagtatatctggaagagatcttccaatacatactatctttttataaatgaagaagcagaacccagagaatctttttttggaaagggaatttgaagaagaaataatttttttaacgtagccggatgcgatggcgcaggcctgtaatcccagctactcgagaggctgaggcaggagaatcacttgaacctgggaggcagaggttgcagtgggccacgatcatgccactgcactccagcctgggcaacagagtgagactgcctcaaaaaaaaaaaaaaatttaagaatatgtgtattcccgttttttacatgtaattgggtatttctaattacatatcacttgttttttattcctgtgatatgataaagaaaacaggcattggttactggttccttgttatttaataaaagaaagaaaaataaacaacctctataagtgttaactaacttggcaaagcaagccttgatttccggcagtcacttagggaagaaagaggccctggaactctggaccccataatatcaaaaactttcactactggaatgcctcatagcatttacagagatccagaaatggaggctgcaaaaattatgactaggtaagagttggctagagacaaggaagcatttccttggccaaaaatagagctgaactctccttgctgttgccagcattacaccacatacatttccaccagttatttgaagaccccttcacaaccaaagacagccagggcttcgcaaggcccagacaccccgctgactcatcccatctgcagcgtgcaaagtgctatttgtcactgcctagttatattccactctgcccaacagaataaatattaagtaagcgctatgtacttacataatttgcagaattgatcggctgacttaaaagcttgaatccccaacaaaagaaaatggagtgctttgtgcaaatgttaaatgcacagtttaattggcaattgtgtgttggaaagctattgtaaaaggatcacagttttgaggtgatgctccagatagcacagtcagggaaataagttttcatctttggcattaaaaaatcaggtcttggaattgaagtaaaaaaaaaaaaatagggcagcctcagtctggatctctgtctcatcagaatataactttcttcctcctacactctgcctcctaaatcagaatttagaacatattaaatatgtaggctttaaagattctttccttgcctaaataatttatacacgtctactaaactgttaaatatcaaagaaacacatgcacatggacacacacactcagagcattttacaacagtgatttccacctcccaaaaatttaagaacgtgctcagcaggaagttagagttgtcaggtcccctccagtggaaacttaaagaaatgtgttgtattttgtttcaatgaggatctggatggagagttcgccatcttgattcacgtaacaaaaataggtgagagatacatgtgatccccgaggagaactattagacttcccttagatgcaaaggttgtctcagtcgtgaaaaaaacgtgtgtcatttcagcctattcagtgcattctgcagcacctgctagaatatttatcctccttctctttccacttaagtcctacatttacataaaggctactggagggttccatgttgaagcaggttttatttgcaaaactcagcctccatggatgtgtctttctgcagcattcctttgtgcctctcattatcacctaagggtttataaaatgggcagtggtaactctagttttaaatctagttaactctagagattaaaatccagtaactctagattaaaatctagtaactctcagctattgtgaacaagttgaagttaaaaaaaaaaaacaaaaaacctttcttcagctgcgactgaaaaagatccagtgataccaagcgtacctagtttccatcctcataaaataatctcttaagtgtaaagaagcccagtgcaaaccaccatgaattatcatcatcgtttcctacagtgagttcggaaattgctttttgcttctggatactgtgaaaagccaggtcaggaatccacaatgggcatcagtcatcattgtgttgctaatacttgccatcggttcaagaataggaatattaagattgcatttcttcattcttccttgccaaagggaggaacaagacagtcaaagggcatggacccctggcccttgattgaaaacactaacagatatgcatgcagttagaccccagtgttcatgtgtccaaggcaataggacttccaggagagacatccaagtgaggaagctgcaagtgctgcctggaaacacctctatcttcaaactccaccctctctggcttggttgggaaaacctcattactctcaattttctaccaaatgatggtgaagaggagtcatttgttggaagaaagggattcattacagggaaacaggtcttgaaaaggatcaataccatggctgcctccttgtccagccaaggggaacctgtgtggctctcccaagcctgctctccttcaggccctcagaagttcatgctgtcattaggacagtcctgcagtcaatggcagggggcgtgatgtcccgaggtgtgtgaggtcttccctgagcaaacctgtcctttccagtgacctgccacggtgcccaaaattctctcatccaacactgtgttagtgagttgcttgaactctggggccaggctgcagaattgagtgccagcttttcttcttactaactggataacttctggcaaaatttaaaatagcagtaattgcagtatctacctgataatggtgttggaaggattctatgattaatacctaggaaaaacttgtgagtgtctggtgcattctactatgcaataacattagttatttttattatttaacctcagtgtgttgtctggcaaatagaagacacagtcagcaaaacacagaaattcgttaatgaagtgaccgccaggcacctggacgagccctgagggtataggcaaagacatgctggtagaggaaggggtaagagagacctgaaaattgaggtctgtccagggaggccgggctggagacaccctgagttcctagaaagagcaagttatctatgagggagaagagaaccattatagtggtaattgtgcaaaaaggaaaaaaaaagacaaaagaaaaaggcagccgtaatcgttagatgccagggacagtgctaaccactttatttatatcatccaatttgatcctaaagcaatcttataagctgggtatattctcatttcatagaaaaagaaacaggcctggagtgccctctcagttagtcgatagtggagctgggagctaaactgttgcccaaactggatccatccagctggcacaggtcataggaaccccggggtctcagcacttcccagatgcctctgttagtgcttcctcttacttggacccagttgtcttaggaaagcaagacagcagagaagcccagctcctttctctcttcctggtacagaaccagcatcagcattatttagaatccagatgtggccaatgtgggatggctggaggagggaacaagctggcagacagcccccacctgggcataggtacatgacaggagggaacgagcaggcagacagcccccacctgggcataggttcatgaggaggaaaacctgccaggaggattccacacctgagtcagggagtcactgggtttttccagcgagcacccctcacgtccatctccatgtttcttcccgaccccttcgctctggaagtgaggagagggaagtgttaccagttgatgttgtttatgtaatgctaggatcagccaaagagtgaacatcctgctctttcaaaatgaattgttggtttgtaagggtgtttgctgaccttttcaccagtaccggggaagaaatgcgcatttatggctctctttttggctttagaacagataatcccagggcccaatctttgccctcttctccacctccatacacacaaggaggcattggtctgcggaaactgtttactcagaggaccagtggccctcgtgcaactgcagtcaccaagttgccatccgggctgcagctttcagctggctctcctctgtgtctgtgctggaggtgatgaaaccccaggcttccacctgccctcatcagggtccacacagggaagggacagccttgtcttgaggcctttcatgctgaatctaaacctccccattatgaattgacgtggtgttacttgggaagggatgatatttctcaaactcctcctgtgggcttgtcacagcgccctgccccttcctccctcatctcagctgcccctcactgggcatcggggacaggcaggtattcttcactttatacatgagaaaggcaggcccagacagggtgggtaccttgcctccatcacatggctcatcagtgctggacaatcgagtatgaaactgccatcactcccatgcctgcctcttctctgtggagacaacttcaacttcagaaaacgttagtgagtcttatcatattcctacagccacattccagaacatgctgattttctcatttcaggacagtttccccaggcgctttcaacttcttataccttaaaagaaataccaaatgcattactcatgtctgtgcagtattccctaagaaaataaagacatctagctcataggaattccagaaagataaatgaaaaataaatgaggcttcagaatgctcacaaaacaaggactctatttgccttaaataattaacattgagaattcaaacctgaccaacttttcctccatgattaaagcaacccagggagagggcaggtgattccagtgctgggggtccctttagccataaatgtatggacgtgtgatgccgtagcactcagggcctgggagagccggggagcatgaggatgatcgaggtctcggagctcaatcaatcagcaagtgcttcttggtcacctattgtataagtagaaatggatgccctatttatttatggaaaccatcaattgttgaggacctaatatgtaatctcatctaggataaaatccttgaccttgaaaatcacaatcagctgggagagaacacagagtaattgttagaatgcaagatggcaggtgccatgacagaagagcaggatggatgctgaggagcacacaggtggggtactagctcgggcctcagagcaggcaggaggacctcatccaggaaacatctctgagttcacttcccaaggacaagtttagccccaggacaaggaggagatccagaaggcattctacaaaaatgctcaaggaacaagggcattggagcacaccatgttggcagggaaacagacaaagaccagacatcagcgcttgctcagaatcctctgctgctctcgaagggctgtgtcctccacaggtgggaggatgccacctgctctgatggtccaagcagtgtgggttcagccagcgctcttggcacctgggagcatgattccaaatgtagacgtaatccagacctgcagcttcaaaaaaggagccaccgtggtcagggtcagggctgacacagggccaggggaagagagtttgcaagtagcaattcaatacttttatttcagaatgtgtagcaagtatttgacatatatgtataaacaaaaatcatataaccagtttcctagaggtagtccaggccatgaaggctgcaacttattgtttctctgccctgacttaaagcatgtgtttccaagttgatgcctgttctttttatgcctcatcaccaccctgagtgttcagtgaggaattgctgcaaggacaaagagttcccaatgtaatgtggatacaaaagaatccaaccactcagcttcatcagtgcccttggcaatgcacgtccaagaagcctcgcacacagagctgggaggccatctgaggtctgaccactgtgcctgccagaagatgagcattctgtttgtctctacagttgtgtgtgccctgtggcactttcacatattaagatttgaaccccaccaccccccaaccctgtgactgatccccacagcctcccctttagcctgggtgaattaattgaaatcataggagcagtcttagctgtgcccgtcatgcggtcccttgagacaaatgcattcggtagatgatacatgacagcctgaacacaggccagggaggagaccctggaaaagcagggacagaaggaagacaacttcccagccagcggccttcgcttcaagacagaatccactctcctccctgctcaccagtaacatgagggctgagcaaatgggaagatggtctttgagagttatcgacttcctccttttccagcaacgacatcatgcctctaagtagcagttcttaggaaacatgaagcccccaaggacagctggctggaaactttcaaagctttgcaggcataaccactaatgaggagcaaagtcgctgtttatttgagatggtgacagacactatcagcacacttcacacagttcagatatgtgtttaggttcagaatgatggggatttcaagaccaaaggctctcgaaaatttcagcaacccaatttattcaccaaagcattaagccaggatctattttacatcagattgtttgaaatagtgatgtaagaaatgtgctcttgatgtggagcctccagaaaaggacttgatgtgctcatgggttctcatgacctctgaggtctttgctgcagagaattcaccagcctagtgcctggcacatcacaggtgctgtgttaactgaaagaatgatgaattattaaataaacagccactgtgatgtggagaggaaagagttgggcacacttgggttcaaagagcaccacctccaaacgccaccttgcctgcctacttctgatggacactgttagcaaattgcttaaacactccaagtttgtgtttccttatcagtaaactagggataaaaatatgtatcttcactgggcatggtggctcacacctgtaattccaacactttgggaggctgaggtgggtggattgcttgagcctaagagttcgagaccaggctgggaaacatagtgagacccgtctttaccaaaagtagaaagaaattagccaggtgtgggggtgtgtgcctatagtcctagctagttaggaggctcaggtgggaggatggcttgagtccagaaagtcaaggatgctgtgagtcatgactgtgctgctgcactgtagcctgggtgacacagtgggatccagtctcaaaacaaaatatgtgtcttgcagtgttgttgtaagccttgatgcactctttcctagtgtaccgaagcagcctaataaatgttagccccccggttgcctttccacttaaagagagatggggtgtattagcccattttcacagtgctataaaggtactacctgagactgggtaatttatgaagaaaacaggtttaattcactcacagttctacatggctggggaggtctcaggaaagttacagtgatggcggaaggtggaaggcaaaggggaagcgaggcatgttttacatggcagcaggagacaaagcatgcaggggaaactgacattttgaagccatcagattgcatgagaactttctatcatgagaacagcatatgggaaacctcccccgtaatacagtcacctcccaccaggtcccctcctccacaggtggggattacaattcaagatgagatttgggtggggacacagagccaaaccatatcatgaggaggttatatcaagtggatttatagaactgagaaacagttgagaggctctgtggtgtgcggatggttttggaggttaaacaaaacaaagaatactaataccagagttccttccttgaagccagttaagatcgtcacactcaaagggaagagatagactttatcttgtctctcccagtagattgataatggcaggaggagaaagggcctttcctatcctttctatgcaaaagtgtggtgtctggaacagcatctgggtgtcaccagacagtcttttggaaatgcagcatctcagcttccacctaagtaggctggcccagaatcaacatgatgaggagatccccaaatagtttacttgcactttgaaaagaaacactggcctagagcaccttcccctctctgggtcgccaggttctttgatttattaagtctctgcagctgactgatatggagggcaagggtacttttgaggaattttctgaatagtaggctgaattcttcaaccagccaaccaaacaacagcatgaatctatcttatactagatacgtactgcttcttctaaaaggctgcagagagggcagtcgtgggcccagtgaacagctgcattctggtcggtcctctttttcccttcctctgccaggaaccacagcagtgttgaggttctgtaagcacgtgcccagttggcaatgagcttatctctgagcatctgaacagaggagaagcccagagcagcctggctccagggaccccacgggacgcattgagtgctgagctaactcagggaggagaccacaacaaatacaaactctgggaaatcagggacagggcaagcctcttgggattcatccccggcggacatgcccagagactgtctgccacagcttttggcaatgacagatcttaccatagggctcctactaaataccctctggaaaagcactggacagtgacccttacttgaggatgcataatcaagggtgtggtcatgtagccatcataacatagggatttggaagattgaggtatgcggaagggccagttccaggaatagagctcatgcttggtccaaggactagggcagggccttcaggagctcgtggctttgaggagggataaaggagaaggattggtagcaaatggcccagagattcttacaaatccaccttcatccataaggaggttggagggtgtatgatgatcctctcttctaaaaggctccctttcaaattacagaaccattgggtaattcttctattacccagggaatcagtgccagctccccaggcactgagtcccaggaggaagacagctcatcttcattcgtgggaacctgtcctatatgtgattgtgcccttgggtaaagtggactttacaagttcgttattgctgttgtttgagcagaggtcatgttttttgtgttactgttgtttttttttttttttttcaaattataaacctcatatatatgttaaagcttaaattcaatctgatgtagagatttaactgtggaagtgaaacctctctaaaaaaaaaaaagatcctaggaaacaactagaaatatgagatttattctaatcctaattgcatgttccatatttagacacccttcccacaaaaggtgagagaaatgcttaccttgtccaattttacgcacaagcctccactttaaggaaacagattactttttttttttaaagaactctcaaattacccattgataaatacagcactcaaatttttttttggaaaaggcacaaaggtaaacagataaaggagttgagtggtcacctcatgacaaggacagtttgagggtttactcttgttttcatgggagcattggtgcgggttacttcatctgaaagaaactttgagctctgaagctatgtctagcacatgttaagtaagagtggtccttggaaatttcaagcgttggtttgcatggaagcacaaatcatttgacccacatgaaaagaatgaaatgggatggaacagaaactcaaatttaaagtattaagtgcttttgtcaactgcaaataacatgtctctgggatgttagtgtgtaaattgggcagtaagattccatgtgtattagaaataaacttaattatttaggaggtagggtggacctcttcttacaaaattatattttctaaaagaaaataaaagcctatgagctatcaacagacatattgttgtaacaacataaaaagtacatctttagccagctttcactcatccaggctagtgcaaataaggtgtctattaagaaatggacaggtcatgctcaaaccttccacgaggctgtggtcccatctcatccctttctcactctgacaggggcacagtgaacttcctagtccattccatgtcctgcccagctcagggtggaggagccaaagagccctgctgtgaccacccaggagggagagagggaagggcttggttcctccacgctgcccaagcctggtctgtctcagagggcagggctgaggaccagagcgcctgtgggccagatctggagcagctggcgggagtgaatgacctgtgattctgcgtcctccctctactgtggtttcctgtctctgaaaccttatttctctcagcatcctgactataattaacatatgaaaaaaagaagccaaataaatcaagagaggctgaagcccttcgcatttaaaatccatccaccatcgtttcccccattttatcagctgtgcatgtgctgagatggattatgcattgacactgtctttgaatagagggtgagttgggatcctggtaaagcagccattagaccattaaaggcagtaggagagatgcaggaagtgccaggatcactagaatctggggtccctaatccacacaacctcacccagccttacaacaagtcctgtcaccctgaactgcccaggcttacagagtaccttcaaagatgtgaaggggcagcttatctttcaaggtaaccaaaatatcatcttgatattaaatcagattacttggctaattcatcagtttccctcagagttaggtaccctgcacatgtcgttgtcacctttagatggcctcatgcatgggaatgtgaattattcataggctttctttgggttgcaggaaaccttcatattgctttagtttcttaatgtatttgataggctctttgtgtatgatcacattatatgggtattgctggcagtacagtaaattttaaattatatagtctgcagctttgcactaagacatggtaggagatgattcatcattttccttgtcttcctgtttacatgcggacatataattcatgctcagaaactatctttcagctcatctggaagtgctccactgcaccaccacagaatctatctctgccagtccagaattgtaaatcacttttctattaaacagcggggctaaaaatgcaaacatatgtactttaaatatatgtagccatctccaattcccagaagatgagccaaaattaaaggatagtcaaaaaagctagtgctagaatttaatgaatgaatgatttgacttgagatcagaaatttgcatttctgtacacatattgaagatatatatacacacacaggtttcccagaatgggcctgtctttgggaactgtgtattctgcagattttgtacactgaatctctatcattctgaaattttacttcctaagattattcactcatgcagagtcacaagacagacttgatggtggggagaaaaggtctgtataaattctcagtttagcatgatatgaagcccttgtctgccatcctcttgaccttcatccccaggccaagacaatgaagtcatttgctcaggatgatggacatctagactcagtagtgagtgcttttcatctccaaggataagattccacccagcaaatctgcctactcaggcagtagtgggagttagatatttcagaaaggttttcagcagtcactgtttctttgcccaacaatacacatcatcatggttctctactccctgaacctgattcagctgtgatagtggataaccattttcacacacatgctcatgaacatctggcattgttgaagaaggaagacctttccgggtaactgaagcttacccattgaagagttttttgtttaatattgcagctgtcttaatggaatccttctgaactgtattatttgcttgcctactttttttttttctttgagacggagtctcccactatcgttctgttgcccaggctggtgtgcagtggcatgatcttggctcctgcaacctccacctcctgggttcaagtgattctcctgcctcagcctcccaagtagctgggattacaggtgcctgccaccacacctggctaattttttgtgtttttagtagagacatggtttcaccatgttggccaggctggtctcgaactcctgacctcaagtgatctgcctgcctcggcctcccaaagtgctgggattgcagttgtgagccactgtgctcagcctgcttgcctactttattaagcaaaggctgccaaaccatttcatttgtgattctgtgattctgccgagaattgtggtggctgtctgtccctgtagaccattggttgccttgccttggagctcacagcctttcacctgtgctttatattcttgtacatttcaagaactagagttccaaaatccggtttgctagacttgtgctatggtttaaatgtatgttctccctcaaaatgcctatgttggcacttaaaccctaatgtgatagtatcaagagatgggtcctttgcggaagtaattaagtcctgagggctctgccatccttaatgggattaagccccttataaaaggggcttcagagagctgcctggccctttctgctcttccattccttctgtcatgtgaggacacagtaagaaaacaccttagctaatgaacataggaacataaaaccaaacacctcacttataagtgggagataagtgatgtgaactcaggacacaaaaaaagatacaatagaccctgagacctagctaactggggaaggtgggaggagagagaggagcagagaaagcaactattgggcattagacttagtacctgggtgatgaaataatctgcaccacaacctccctgtgacatggatgtacctttataacaaacctgcccatgtgccccgagcctaaattaaaagttaaataaataaaataaaatgccactgggaagcagaaagcagccctcaccagatgccacatctcgtaagacatggagactgttggcacctggatcttggaattccagcctccagaactgtgaaaaaatacattcctgttttttctaaagtacccagtttcaggtatgttgttatagcagcatgaatggactaagacaactcatatgataagctgggctgccaagtcctgcagaaatacctgtgtcctcttcctgcacagtacaggtcagggctttcacgaacaagttttgctgtggctcttctggagttccaggggcccttctgtgagtgggttttggggggctgctttcttccttatttcatggtagtcttgaattagtgataaacagagtttgaccatatgtgtggataacatgtacaggtcttgattgaaactcaagtttgaagagcgtttgctgggtgccaggcataaaaacggggttcctgcttgtattaggcctcaccctcgttatttaattacccactaaaggcctcttaacaaagtcactctggccattaggtttccttttattgttattgttttaagacagagtctcgttctatcacccaggctggagtgcagtggtacgacctcggctcactgcaacttccaccccccgggttcaagcaattctcctgcctcagcctcccaagtagatggaactataggtgcctgccaccatgcccagctaatttttgtatttttattagaggtggggtttcaccatgttggccaggctggtctcaaactcctgacctcaaatgatccacccacttcggcctcccaaagtgctgggattacaggcatgagccactgcacccagcctaccactgtgctcgaccctcattaggtttcaatatatgaatctggggggcatcagaccctagcacagcttctcacatagcccctctcctccccacccagcctctcttcttcctttattacttctgttaagtgcagcctattcattggttgaccttttcagtcctataactcagtggcttagttttttaacaataaatcacaggaaggtggcttaactattgaaaattttattaaaatggttataataatgacttcattactctctgaggcttccagatcttctcttcattccagggaagctggctatgtgaaggcatctgagaattgctattaacctctgctgaattaaaaacaggagcggatgaacaatgttggaagtgggccgagggcttttcagagataatagttgtatgatagcacccccagtttaaatataacacttttgcattataaaaaaggcatattaattcatggtaaattgaaaatttaatttaattttctctagatgagtgaggaaaaaaaaaatgaagactccttactctgcttgattcagttaccatggggatagaacatcttttcgggagaacctctgtgacatggcacatgagccctcaccttctgcttcacatgcctggttttgtcgcccacttgctcttcctgatgaatctgccccagcatccaaatagcacaaacccatgaatattctgtaacccattttcatctttgagcctttgctcctaatctgttacctttgacccctatcctcccagccacccaaattgagcatatcttccaatgcacaactcaagtcccaccgcctctgtgctttctctaactccacagccacacacagcctgtcctctggccttcctcaggtcctaacagttgaggtgggcataaaagaaatgagcagatgaaaataatctgctttgtagccaggcgcagtggctcacgcctgtaatcccagcactttgggaggccgaggtgggcggatcacctgaggtcaggagttcgagactagcctgaccaacatggagaaaccccatctctactaaaaatacaaaattagccgggcgtggtggcgcacgcctgtaatcccagctactcaggaggctgaggcaggagaatcaattgaacccgggaggtggaggttgcagtgagccgagatcacaccattgtactccagcctgggcaacaagagtgaaactctgtctcaaaaataaataaaataaaataaaataaattaaataatctgctttgcaacagacagaactctttcagtaaaatatccagatccggaagctcatttcctgcatattttgtctgcctgatgagcccctcctcatgtacctgcatctctttggtgatcagtcttcaaggcatggggtggaaccaccagtgctcagtctggaactccaatggtgtgattggcaggagcagagatgccacagcctttcaggtcatgggaaggctttttggtggttgttggtgttcttcatgtaggaccctgacaccccttccgtaaatgtaattattgttaaaatgataatccttgagataatggaaagcaacccagtgaggctgtggaacctgcattgaaaattgttgaggtagaacagactgctacaggtgagagagtcttggtttccactcctgtcggcatttggcatttttgcatgtacaaagtctgttccccatcccatgacaaaccccaggtgaatcactggacataaagatggtatggccaaggagaagcaaaacattgcagaccgtctctaccagcagaagctcagcaccagggtgcaactcagatgacagattgtaggtaaacacgtgtgcttactacccattcattcattattcattcatccattaacacgttttgcaaatattctttaagcatccattgagtgctaggcaccagggatttgatgatgggcaaatatagaactaatgatacccagtcagagagagagataagaatcaagtgtaactacataagcaaatgtaaaaatgtaatggggacacactctctgaaacctaggagttggtgggagatgctggtaacagcctctgatagtggggtgtaagccagcaagatcagccaagccccctgaggctctgagatcaaattgaaatccgaaggatgagtagaagatgaagaatggtgaaaagaatgttagaatattctaggcagaaacatgtggccaagtcctgttgggcgggggcagatgagaggaaggaagaggtgggagatgtccctagtcctgcagggcgtggtgtgccacatcttcctagaagcaacgggaacccatggagaggctcttggggtgagggtagagtgaggacaacttcacatttgcacacagggaaaatcctcttctcttcagagtggagaataggcaggaggggagtgagcatggaggtgaatagaacactcagaggccactgtggcccagccggggaaacatgacctgaccattccctgggaagacactgtggcccaggaggacacacacactgtcactgggaggacactgtggcccagacagggacacacagcctgactgttcctaggagaacactgtggcccaggaggagacacacagcctgactatccctgggaggacactgcagcccaggaggggacacacagcctgatcattccctgggaggacactgtggcccaggcagagacacaggcagcctgaaccatgatggtgatggttgagtggagagaaatggacaacgttaagagatactatgatgtaaaatccatgtgtgagccaggagaatagcttcaacttggaggcggacattgcagtgagctgagattgcgccactgcactccagcctgggtgacagagtgagactctgtctcaaaaatataaaaaaatcaaataatacaataaaataaaatccatgtggcaaggtgacccactgattttgggttgttaggaaaagagaggtatcaaggatgactgctaagttctgtgctctggataaaaatgaaactcaactttgaggaaactgtgtactctaaatgtttctgcattggtctcccaggccattccaatcaactgcaaagcttcatctttcataaaacatgaccttaaatgaagacttaactatattctaaagtttgctgtgtacattaaataccatatgtggtgaacatttccaaattccttaactgtgtgacacttcatttgtttttggtttcaaaatggaaatcacaactgtccccaatgtatagagttagattttaaaatttaccaatactaggcaattgcacaaaagatttctagtaatgtccacaggaaattaacatcagcaacacaatttgatgacgtaagagggcttttgcaacatatgatcagttccttcattgttaacattttaaaaacattctgatatcagggctgggcatggtggcttatgcctgtaatcccagcactttgggaggcagaggcgggcagattacttgaggccaggagtttgagaccaacctggccaacatggtgaaccccgtctctactgaaaatacaaaaattagccaggcatggtggcacatacctatgatttcagctacgcaggaggctgaggcaggagaattgcttgaacctgggaggtgaaggttgcagtgagccgagactgtgccactgcactccagcctgggtgacagagtgagactctgtctcaaaataaataaataagtaaataaaaataaataaataaaaacatactgatttcagagtaagcatatcatacacaagaaattacctttatacctcgaatcccttttgatttttagaaaaataagctcagaaaatatgcacttttcttagaatagtctgcaaaaatttaagaagataagagttttctttcagaagacattatacagcctatatattttaaaatagaatatatatctatagaacaggtacatgattttgagcaaatcatgttacctctcttgaccttgccttctttcacaatggatactccaattacgtgttatccaggttcgttttggcttttacgattgtttaattctactttttcaatcccacttcctttacccagtaataatattcattggtgtttttcccttaatcgaagaaaaaaaatgagaaaaaaaaatctcattggtttgggagtctactctgtgacaggctttgagcatgtgtatatatcttattagtaatctcagcacctgtaacacttgtgtagggaatgtttcattttacctattctatcgataaatagcctgatatttaaagaacagagacatttactaacttttctaaagttactggaggcaggatgtaaacatacgaatttctggcttcaaaaccaaaattcttttcctgggtcattagaatcccccatctaccaatacactagtgcccaccctctctctgtggagtcagtaatactttaacttcgtatagcaagcaatgcttcaaagcaacctcacagttttggtcccactaccccttaaaattggaaggcaattcatgttacccacttttgatgaatgagcaactgaagatgatccagcagcagccaccaagtggctgagacacaactagaaccttgtctctctattaaatgcatttcctgatgacacgatgctgaaccttgagactcacaggagattaggcccatggagaagtgggaggaagaggaacaggggaggagaaaccatggccagagttctggggctgaaggaagatgagagggaaggtggagtcctcaccaaatggcatcatgtctgcaaggtgctctttcagaaattccagtaagatccaaaagcatcttgccaatgaaactagaaaccatttgataggttcgatctggacaatttttgtcttatgccagatgtgagttgatgaatgtcaaatgatagtttcagatgtaaacagcagggttcctgaccacagcagaagagcagagaaaggaaggaacccttcagctcacagaatgtgaaaggcatcagtaaataggggagcatcagtgcccatcactgtcaagggattactccaagacacagggattcttcggggggcctttctaatgtcttaacatttaatagaattgaagtgtctttcttcgtacagtattgcaatccatgtagtatgggaactttatcaaactccagaatatgtgacagtggacatgtgatcctattaccaattttttcaggatcgactctacatgggcatcctcagtaggctctgctgtcaaaaatccataattaatgctgttttaacaagtgtcaaggcaaatgtggccatttgtagagaggaataattatttgcttatttttggtggtatgtgatcttcagagtcagagaaagatggggcttacagtcaggtgtcaattgtcagtaacgtgcccttgacttccaggaagttccttatctccttgaatctctcttttacacctagtgaatgggatgacagtttccttcaaccagtttcaaggatccagtcagataatagatggtaaagtgagccctgtgctattggtggcaatgtaaaatggtgcagctgctacagaaaactgtacagagttccgtcaaaaaatcaaaaatagattacaatatgttccaataattccacttctgggtatttctccaagagaagtgaaattatgatgtcaaagagatatctgtactcctaggtttgctgtagcactattcacaatagctgagatgtggagaccacctaaaagtccattgacagatgagtggataaagaaaatgagggacacacacacacacacccctaggaatattaatgggtgttaaaaaaagaaggaaattccgccatatgctacaacaaggatgaacctagaggacattatactaagtgaaataagccaatcacagaaagacagatatgacatgattccacttagatgagagcggaatggtggttgccagggggttgggagaagggaaagtggggagttgctcttcagtgggctgtggttataaagtttgttattgcaaaatgaataaattctaaaaatctgttgtataacattgtgaatatagttaacagtattgaacagtcactgaaaattttaagatagtagatctcatgttatctgtttatatcacaataataatattaataataacaaaagtttcaagcaccatggcagatgtatctaagaggtcttcctcctctcaccctgcccctcactctgctcctctcccctacactgttgacatcctcctggactttactcagcctgcttcacaaggacaggttcagggtgggtaagacttatttggggagattgtcattcaaaactgaaggagtactgagtgccagacactgtcatgatcagagggtggaaacccctgctatttgaatggatcatcaggcaaaatgaggaagtgtcaggaattgccctatgcctgccttttatcctatgattcagagctctcattcactaaagctacaatttatttaacctgctcagaaatttcaggaggaaaatcagtggatgagaaatcaataataatgaataatctcccattcagaaatatcattagagattatttttcattattccactggtaacagcaaatttaaaagatactgttataaactccatagcccaagcttaatagaattaataatcaaatgggatcctgagatcaataattctcaaattgttttttgtactccaggaattcccagtgtgtacttcaaagtgaatctgacacttcattttaaaaacaatttggagtgacttttgtccctatgaatgatgccaaattgatagtttaaaaattgatgggtttaacccaacaatgaagagactgcaactaatcagtccattctttccttctgcaagggtccttggctcatcaaaccatctcgaagtcctcatttaactaattttattacttgatctacaatttatttcaccccagccacaaaatagaccagtacttagggataaaagtagctgacacaaattttgtttcaaataggtcattattttatcttgatatataaatgtcaaagataccgcttgggttcaaatggtgccagaagacagacaaatgggcaggctatcagagagaaatggaaactgggaaagaatctatttctcttcattttagtaagaacctaagatattgtcctaagcttacaattgcagggacagaaggagaatctgaattagcattaaaaatgattttttaataatatatataagggaacttttaaagttcatggaaaagtggacttaaaagataaaattaaaaacattaactttatttctcagtataagctccatcaagttcaaaacactttttaaagcaatgatgtcagtcatttagtccatccctaaagaactgagggtccctggaatttagccatttcaatgtaaccttttttacattattaactgaagaaaaataggtgccctttacagattttgtaagattaggaaacaaaaagaggtcaaatggagccaaatcagtatggtaaggtgaatgcctaatgattttccattaaaactctcacaaaattgcccttgtttgatgagaggagtgagtaggagcattgtcctggtggagaagcactctgtggtgaaggtttcttgggcgttttttttctgctaaagctttggctctctcataataacacattatagttatttggccctccagaaagccaacaagcaaaatgccttgagcatcccaaaaaacttgctcttgattggtccacttttgctctgactggaccacttccacctcttggtagccattgctaaggttgtactttgtgttcaggatggtactggtaaagacatatttcctctcctattgcaattctttgaggaaatgcttcaggatcttgaccctatttgttgaaaatttccattgaaagctctgctcttgtctgcagctaatctgagtgcaagggttttggcacccattgagtggaatgtttattcaactttaatttttccaccagaagttgaagcaattgagatagctatagtgttggcttttgtttttgctgttaattattggtcctcttcacttagagcatgaacaagatgatgtttttcctcacaaattgatgtggatggattaccactgagggcttcatcttcagcatcatcttgtctcctattaaaacaagtttttttatttgtaaactcctgatttttgaggggcatttcttccataaactttttataaagcatcaattattacaccattcttccgtccaagcttcaccataaatttgatgtttgttcttgctgcaattttatcagaattcatgttgctctgatggaggcttttttttcaaactgaggtcttatcttttttaatgcatcaaactagatcctgttcagacatgttataacaaattagtacaagcttatttggtgcaaaatattttgtgaaacccatgcatagttggtttttataatacacattttttcatgaactttttgaagaacttacatataatatttcaatagtggtttatatatattttaaaatgttttagccttataaaaagattagagaaaaaatatttctggtttgggaattgaacatcataaaggaaagttagagtttgcaagatctgaactggccacctgagaagcagctacattatccacatttccttctctgcaccctcctccgcaccctcctccaacccctccctcctatcctctccccatcctcccacacagatatggatctgatggtatgcacgaagcacatggaaaattctgtggaaagacaagaggaataagctatggcccccactcttaataggaagtaggtaaagatttgctctgcaaggaatgataatcaacaaactatttctcagttcttaaaaagaagagataagctagaccttgattagatgcagagaactgtcattagagatgagtttctcttgccttctttccccctgttgctgtgacttcttcatctttaagggactgatgcagcttcatttccacgtgggtcttgtgcctttggattccagctaaaagctcctcccagctgtgaacctgggtcatagcccatgagagccacaagggacttgagtgtcttctggttcaaccacctcattttacagttgaggggctggtgaagggactttcccagtgtccccctgagttagatgtaaagattggggctagcccaaaagctgtctgagcctcagccatctgtcactcattcctggtgcttctctcacctcctcaccaaaagacaaacactgtggtttatccaaaagtggccttgcagattttctgattcatgtctttttgccactcaaaaacattgactgaatgagccctgagtgccggatactgttctaacctatagactactgtgtgaagagtagaattaaagtaaaacaaagacaattataacataaaatcagtccaaactattctacctgtaagtgcataaaatgataatatgcatttttgcatcactgtaaagaaaagtatttcatgtcaccagttccattcagagcactgtaattggcaattacttatttttgacatttgtaagacttcttgaaagatagaatttgaatgctgcatctagtgactgattcttcttgcatattgagctgtttcattattttctactctgctttaaacttgaatcagtatagaaccctcccacattcttgacagggtcctctttactcaagatcttgggatcacaggtttgatctggatcaccctgtctcgtatcttggaaatgatgtctttgacatggatagagatggctagcatgactttgatttgttgtctgtgcctttccttgtggcatgagaggaggctgagaaatactgggctattgtgaatgggaaatgagagttcttacaggcacgctgagcatcccagttttgggcattcagtccaagttttgtgtgaggacatcaggagcctccctaggaatacgagtacttccttcagtgcatcaggcagtatgattagaaccacgatgtaagtgtcaggataacatcgggcatgagagtctgttgctgggtctaatagcataaaacaggaggtggtcacagcaagtataagcactgggaggtgtcggcatggaataataatactggtgcaaggagtgggcttaacatcataactgggaacccagaagccagcaaaatgcaaatcagacaggcaggcagcttctgtctcccttctgtgtctctatgcctgcagtgaagactacctgttgtctctctcctggagcacttgcgagccacagatgagagaggacctttcagtgactgattacagcctaaaggctccaggaaacagccaccactgcgggcttcccccacgtgcttctctgaaaggttgtcagcagtgtattgatgattttcaagtatttgagcatacttgtagcccttgaggtcaaccggcttccttggagatggccattctactctaccagccagggaggaactgtccatggtgctgcttcgcatccagaggctacagggttgccgtgtgataggagccacctgggcagggacttaccctcaaacagcctcgtgtttcatggtgcagcactacagggacaaatgcttacctttgggccagtggagagcaatagcaatcaggacttgggagggaacctaagaggataggacaagctgatagggtgagtggggtgaggtgagatgacaaaggggcaggtactgaacaaaatcaggctatctaacaggcaggcatgctctttaatgggtagggtactatccagtcaagtgtaggccaagaaacagcaatcaagattccttggcccagaaacagggtgtcccagcaaacacaagagcccagaaacagggactctgcaggtaggcacatttggaagctcagggaggcagacttctcctctggagtgatcatctactgatagcaaaatcctagtcaccagggagggctttggtgtcaggacctcaatccctggaaagtagataagtaccatcagaacaagaaactctgtctggattggaatggtgttaagggcatcttgatatgttattcctgcttaagtgactcttaccttccatgaggttggttgtgaatcctagaggctgtgtatggagaaccaatggccctgttagaaagggtggacactgggcagctcatcccacattcagaccctttgcagcaggtctccatgttagcatgttctattttgacaaagccttttgtcctgccaggcatttaatggacttcacacattctacctgcggagctcacatcagggtatctatatctgttcctctagctatatttgtgtttgtatcttgatgctgccaagcatagggaaggcagggagaagccaaaagtcagcagaaaacagctgagataaatgacatacaatgcgggaggaacgcagatggaaatagatggcatgggagtttgaagaagcaaggagccacgaagtgctaaagtctgcaaggaggttctcaagctcatctcactatttatatcacagattacagatttcctgctcgtgtcaaaaataagtcattgccagttgctgtgttttgaagaaagaatcatgcttaaaattatttcacttagaagctcacaaatgaaactgttgactctaaggaataaactgtgtagatagtaagtcttaccagctgtgaattagagtagtttgtgagagtcgaattcagacattttcttttttgagaaaagctggaatagaaagggaagcacttctgccaaggttaacagtaggatgtctttataaattcgatgtagctgtgagggaagggacttctgcaagctttcgtgcatttgctcattcaataataatctgttcatcagtgcagtgacacaaaatatttacagaacacagcatcagtggctaaggagcttataagcaaatgaaatgttaggtgtgttatgtgtgggttaaatggtgcccacccgaaattcatatgttgaagtcctaacccccggtgactgtatttgactaggggtctttaccaaggtaatcaagttaaaatgaggtcattagggtgggtccaatctaatatgactggtgtccttatgaaaagaggaaatttggacacagacacccacagggagaatgccatgtgagatggaggcagagatcatggtgctgttccgacaagccaaggggcaccagagattaccagcaaacccaccaaaaacttggagaagggcataggacagattctcttacacagcctcagaagaaaccaaccctgatgacaccttgatctcagacgtcttgtctccagaaccatgagatgataacttttctgttgtttaagccacctgatctgtaggactttgttacagcagccctagtaaacaaatactttagaaaaagtaaaaagagaagcgaagcaaaacttgcatgcacaacaggtatgatgatgctcatgactacagacagtgagaaaggctgtgggttggattactctggctcagcctcatagaaaaattgaggtgaatgtttaattgagtgtggggttggtctgaagagaaagaatagaaaaggagaatcatatttcatacccttactattcagtcagctatggaaagcatatttggggtggctagaagatgccaagtacagtgctaggtgatgaagcagtgaattaagttaggacaatgtggcccatgtagcctctcaacaggaaggcaggttcagatagaggaaacagcaggaaaaaggtgacaacttgaaaatgagtctcttcctcattcaggtagctttggtgctttgcccactggttgtataagagaatcctgggaaacagcctatgagtagtatttgatatcttgggatgtgggaggtaatcagatttcagtgatgataagacactcccatctctgagctgggtgtttcccagaaaattccaaggacaactggcctttaacatctctctctatggttaacttgctaaacattatccagaaatagccagcaccaacatctccttcaggaccccaacagccaggcattttctccgtagactttgctccaagcctcttatttctgggtttggatcctacctttggacttgaggggcttagatattatcacttaggtggacaaaccatccagttaaacacacacacccacacatacccaacacacacacagacacacacatacacagaatcaacactcaacacgcaaacacccaacacacacatgcacacacactttctgaagatgagttttctcatttatgaaatgagctcatctggacttgccatgagggtccaacaggtgccatgcaatcaggtgtgcactcagtatgggctgggtggagatggccatctcctttcccgtccaggcctggttcctgtgtgctgggcctctgctcttcccacctcacacagcccctgcatggaacagagccggccctgggaggcctgggatccccgtgcctcccttcagcccctcttccaaaatcttgataccggacacacaaaggacacagcagatggccattgtatgatgggttttgttctgttttgttttggtgacagctttattgagatgtagtttttaccatacaatttacccatttaaagcatacaattaaacgttgtttagcctatgcacagaattgtgtaatcatcaccacaatcgattttaggacatttttatcacccccgaaggaaactgtgccccttagcagtcactctgcatcctctgtccccaacccctggcacccaggcatctgtgatcactctgtggatgcacctgttctggtcagctcatccacatggtatcatatcgtgtgtgttttcttcatctgacttcttccctgagcgtcatgttttcaaggctcatccaggtggtagcctgtgacagtgcttcatgcctttctattgtcaaataacgacacagtgttttacaacccctttccacataggttagtatcaccagtgtgcttggatgaattgcagtttgcccagtttgctgttccaaaagctagagaattcctttttttcttttttcctcttactatacaaaccaactctaagtgataattaaaagcgtgagctttgaatttaatcagcactttgttcctttctattgtcaaataactacacagtgttttaaagcccctttccacataggttagtatcaccagtgtgcttggatggattgcgatttgcccagtttgctgttccaaaagctagaatccctgtttttctttttttccccttactgcacaaaccaactcgaagtgataattaaaagtgtgagctttgaatttaatctgcctagattcaaaatttgccatgccatttcttaggtgtattacctgggcaactactaacaccttgttacctcagttttcttatctttattttatttatttatttattttgagacaaagtctcaccctgttgcccaggctggagtgcggtggtgcaatcttggctcactacagcctctgtctcccgggtttaagagattctcttgcctcagtctcccagctatctgggattatgtgcgtgcgccactactcccggctaatttttgtatttgtaataaagatggggtttcaccatgttggccaggctggtctggaattcctgacgtcaggtgatctgcctgccttggcctcccaaagtgctgggattacagatgtgagccactgtgtccagccagttttattatctttaaaatgagattaataataataccaaacctaataggaatgttgttaaatttaataatttggtaagccattaaatcacatgaaactatacctggtacattttaaacacccttaaaagctaaatattatatatcatattctgctttttaatataaataggtcacacaatatatcagcatgcctatagaggcatttcatccttaatgttacttaacacttcaatttattacgaacctaaatggccagaaagctcaggtaaacaatttcccctataattttacgcaacaaaaattgggatttataccaatgatctcaaagtagtttaaattcttaggataatttcttagcccctgatgaaagattctcttcattcttttgaatgatcagtgtaattgtacttctagggaagatatagccgtttatttctcactaaaccatgacctgtgcatgggtgaggcagcccacagtgagcctgaatgtttggccaatccattccttatgtggactcatggaaagcctcagcctataatcagatttaaagaaatctgtagccatatgtgtttccctgacgtcggtattgctgggccatattaaattgctttacatccctaataactttgctttctattgttctctattctgctgcacttacacaaaagctccatggcagagaaattggaaagaccagtaaaaaaataaggaaacaggatattgtgtgtcctggagggtttccccggtgctccccagcctccattgcacaacctccctccacacagccccgccccatcacaatttccaacccctttactcaccccctgtgtctcatccactttcctctctgtcaaaacccacacttagacattctcagagtccttcccattgaggtccaaacaactagtgatggtttaaaatcttacgactgggcgtgagggaaggcccataccttgagataaagctaatttgaagctgatggcaggatttccaacagcagccagaggaggggcagagtttaggggcagtgttttgtcctatagtccttaaacctgccttggatgtggctggttctgacatcttgaataatcccttagtatcttgtttacaggtgatgacacaaacaagttatctggaaataaaatgaagggggaatgaaccaaaccactttaaggtagctacttttaacagttttagggggtcagttcaaaagtctttataactaaattctgaaatacagagtgccctgttttcaccttcaggggtctgacacccagtgttaggtttacagtgtgctgtgggccattcatctgggccccaatgagcttagaaaacaactaagtgaacagcagatcctcagccaggtgcctggccccctgttgacctcacctggggtctcattcactgtcccaccttccctggaccaggcttccccctccactgtccacttaccaaagagtcacaccatttcatctagaaaccctcatctccttcttctttttttctcttttccttctcctccttccagctcctaaaatagaaattaatgtagtcctggcccagcagatgcttcagggatctgcattctgttcctaaatgctcagatactcactaaagacaaatagaagtgttgggtccacagtggatgatccctcagtacatcttgaaataataccttgttaaagaaagaaggtcatatccctgctgaggggagccctgggagcgtgtaagtccatctctgggcagggaagctgaccagagatgcagctgttgacatgcagagagaatgagatgtctgaggacaccctctgccagctcgtgtctgagagaggatcccagggacgtgctggtactgagtttcccctctaagcagaagggaacacttcagattccaggaggacatcgaagatgtctaacggatccttttcctcaccaaagagatgtgttatttggtatttttaataacaccatctgccagtgagaggaaagctccgaattgcaatattgatcttgtcactttggggaacagtttgatatttgggattataaataacattttcatttgctctgttatcatgctcaggcagtgtttgatggctgagcccaagaatattattttcttatcaaatataaagatacgtacttttcctgaggtctgaactctgggttgtgaaataatattgacacatattaaagagtaagatgtattctgaaaccttaacaattcagaaggggtgtaaaatttttctccttaaaaatgaaatcgaggacaatatgaggtgataatagcaataactggctagcgtggattaagaggttaagtcagagtcggattagactgtctgatttaagtaacacgatagcctaacaaggaagcacagcagcactattgttcccatgattcagaccagcaaaccaagatagccactgccacggggctaggaagtagcagagctgggatttgaactcaagcacactggttccagagtccacgctgtgaatcattatactctgtctttatttgcacctacatgggaatggattctcttattattatgctatagataccttcaatatttctttctacatttaaaactattctctcttgatcctcatgaaaattatttgagatacacaggacaaatactactatcccagttttacaagttaaaaacccaaggcccagagacattaaacgattttcctcaatgccatattggaagttaacaacagatcgggcttcaaatataaatcacctcactcaaatacatgtatctctttgatttgagcaacacaaaattattaccattattgtcattattgaaagaaacagttgatccatttgaaagataagctacactgtttgtgcttctgggtggctgggatggtaaaggaaatgcatgtggaggcgtagccagcattttgctagcaagctccacaagaatgttttacctaagttcttaggggaaggggaaaatggtcagggccaattctttcatggtaccgagcttcagacactttctgtccaccatttgtactccctctgatttcccgtatggaattgaggtcttgcattttcaagaaaaatggcaaaacaactccaaaaacatgtctttctagtgtcgtagctcttagtagcttccttatacagttgacccttgaacaacacgggtttgaacggagcagttccacttatatgtggattttcttctgcctctgccacccctgaaacagcaagaccagcccttcctcttcctcctcctcatcctactcaacatgaagatgaggaggataaagatctttatggtgacccacttccacttaatgaataatattttctcttccttaggattttttaataacatttctttcctctagcagtcactttattgtaagatcactttattgtaagatcacagtatacatacacagaaaatgtgtgttcatcgactgtttatatcattggtaaggcttcctgtcagcagtaggctattactagttatgttgtggtgaatcaaaagttacacaagggctgggctgggctcaatggctcatgcctgtaatcccaacagtttgggaggccaaggcaggtggatcacttgaagtcaggagtttgagaccagcctggccaacatggtaaaatcctgtctctactaaaactacaaaaaaaaaaaaaaaagaaaaagaaaagccaggcatggtgtttcacacctgtaatcctagctactgaggtggctgaggcaggagaatcacttgaacccaggaggcggaggttgcagtaagccaagatcgtgccactgcactccagcctgggagacagagtaagatgctgtctttaaaaaaaaaaaaaaaaaaaaaaaaaaaaaaaaaaaaaaaaaaaaaagtgatacaaggattttcagctgctcggaggttcaaggttcaataccttaaacttttgcattgttcaagaactaattgtctatgaattttgtaaaattgttcagagttgtaattattatctttgttgtaggttttaaggaaaaggatcaactcttcgttattttcatctctgtatttagctaagtttatgtccaatggggtaattctaaccatattttaagatactgccagcgtagattgtctctgttaccaccggatgcctctggagaatgctgcatgcatcaaaatcaagcagtaaggatgaaaaaatctgctctttcctgaactgaccagccttccctgactgtgcacactgattttatctcaatacagtccacaggcttttgtctttctatgagcttttccttctataataagaataggaatagaaaatgaccactaagttctccatcttccatcccatgcctcagccaaggcaagaaagagtgaaataactgctaagctattataaataactatctcctgtaaaatcatgaacatagagtgtatgtcagagatgttggaatcctgcatccttaatgtttaatggtgtttcctacaaatgttccctgagtattcccagtttggtgatatagtccaagctgcagagggaaaggatgtaacctgatattcatattcagttttccacctgatttctttggggattcacctcatttcctcaagtcctgctaatgtgtacggtggtaattccagcattctctcctcggaatatcaacaatgacagtttcttaattgctctcagtggattttatgtaggatagacagtgaggtttgaccacttgattcatttgaaatgagcaatacttccaccttgacatgatatcatatacttggtattttcatgatttattggtggcctggaccaatatactttgggtcaaaaggtgtgatttaaggaattcaacctaagaatagtaggccagctcattctcagtcattatgtgatttgttggaatattgtgaagttccgttgataaataaattgatgaaaaccttttttcttaccatgtaaccacatactgctttgcaccaatgattgggcacaaatataaacatattgctgcacagtaggtaattcaatatcaatatgtgtgtgtgtgtgtgtgtgtgtgtgtgtgtgtgtatatatatatagagagagagagagacacttttatccatttaggaagacaaacatattcataactatgttttccattaaagtatgttttccattaaaatgtactaaataggagagtaccttcctgtgtttccctgttttatccaaattctcagtgtttttaaagatcccattctggcaggtcatggtgactcacacctggcgtggaggtgagcacctgtagtcctggctatttgggaggcggaggcaggagaatcgcttgaacccaggagaaggaggttgcagtgagttgtggtcactccactgcactgcagcctgagtaacaaagtgagaccctgtctcaaaacaaaacaaaaaaaagatccaattccatccccatctactccaaaatgcctccctatttattcttatattgattaatgtattcttcctcaaaattatattactttctgactcaatatcatacaaaccggcacttatcacatcttgaaatttcccgaagctaacacgtgtctaacctgtttcccatattatgttttaagtttaaaaagattgtctgccgaccgaaaaagtttatgtcaaaactacagaaaagagccatttcttccatttctctaaaacatagccctgtgtcatctctgcttttccacccacccctaccccaacactcatcctacttaccttcctctggcattcacagagggctgagtttctagtagatgttaatcaaattctttgcatgtgattgctcagtctcttttaacttgaaaaggggaaggcagtgtaatagaacacaggaaggagctgttcataggttcagaagtcactcttggattttcaatatttgtgtttcattccttagaaagtgctgtcagttccctctttgaggagctctctgaaacaacaaagggacctgtcatttgtgcatacccccgactggcacctttgaaatgttatccagtcttgctacctaccatttctgatttgtctgacgttgacatgtacacaccctggagcaggtctgttgacttcactcaggcttatggaatattgcatacatccaccgtactccataaataactaatagtgtgaagcagagatcagatcaactgacagactttgtagaatgtaatctctggtaacactgactttaagaggcaatgagtgtgtgtgtgtgtgtgtatgtgtgtgagtatatatatattcccataggctagcaaatgaaaactgacagtgaacttttcctctagctctgatagagtgactggcattgggcatttcctcctggcataaacaactctaaagctggtaaaatgtgcatgacaaatgttttaaggcattaaacaacaggcagcacagaactgtaattcttgagagaaaggaaacatgagaggtgaggctcagtttgccccagtgctctgcctgggaccgtttcctgcacatctccagcagaactgtggcctcactgacctgaggaggagattggagctgtggtctcagaagcagctgagatttggggagccaagtgcaagagcagaagctgaggacaagggtttccagaagtcttgatgaagactcattgctggtttttggctgaaggctgcccacaccatggcaggcagtacacagggcctagcagtggttgccttctgcagggctgggaatgaatgaaggcattattgctatgcaccaccaggagatgctggagctccagctcagccagaatggagagaactcattgagcatctcagtcaggcattcagttgaaacctcagaaagtccacaccatagcagtaaaagctataccctcaaataagggccacaccttagcccataactagaataagttcatgtccatgaaaggaaagacatgaagcctggtatgaccaaaaagatcagttggtaatttccctgctgccaaaacaaaactcagagcacttctaatttaaaaagagattatctagaatcatgaaaacattttgtctatagtatccagaataaaatttttttaaaaaattgctagagtttcaaagaaacatgaatataagacccatgatcaaggaaaacaacagtcaatagaaacaagccctgagattaaatgcctttgatgttgaaattttcagacaaggattttaaggcagttataaatatagccaaggaattaaaggaaaacatggtcataatgagtaaacagagggaaagttgcagtagagaaattataactgtaaaaaataaaattttagaactgaaaatatgtagtagatgggtataataatagttaagaatggcagaagaggccggggcacagtggctcgtgcctgtaatcccagcactttgggaggccaaggtgggcagatcacgaggtcaggagattgagaccatcctggctaacacactgaaaccccgtctctactaaaagtacaaaaaattagccgggcatggtggcgggtgcctgtagtcccagctactcaggaggctgaggcaggagaatgatgtgaacccaggaggccagagcttgcagtgagccgagatcacgccactgcactccagcctgggcgacagtgcaagactccatctcaaaaaaaaaagaaaagagtggcagaagaaatgctagccaaactgcaggcagatcaagagaattatttgacctgaaaagcagagattaaaaaaaaaatcaaacaaaccgtatctcagtgaactagcaggacagcatccatgtggtcaaaatacatgtaagttgcgtctcaacaggacagaggagagaaaaaaattgtaaaataataaaacttttctaatatttagtgaaaaaaattaaaatgcttattttaaaatttcaagaaaccccactggtataaaaacaaagagaaccactcctatgccccaagataaccaaattactgaaaatctaacccaaagagaaaactgtcaaagcagttagagagaaaagacacgttatatacaaggaaacagttctaattaatagtggatttcttgtaagaagatgcagaataatattttagagtgccaaaagaagaaaaaaatacaaatctattgaccctaaattttatataaagcaaaaatatcctctactgtgggtaaaataaagacattttcagataagtgaaaaacaataaaattaagagtcagcagacctatactgcaagacatattcaaaagaagctttcagaggaaagaaaatgaaaccagaaaatgataattacagtatgacatgaaggataccaaaaatagtaaatatgctaataattagaaaatctatgtgtgtttgtttcttaattttcttgaagacacctgactgtaaaatgtatgacaataacaacatagaggatacaagtaactggaattaaactgttataaatgttttaagtttatgtaaattgatataatattgactgtatataaactatgagtaggtaaggatgcacattgtaatccctagagtaacaaattaaaaaataatgcaaagaggtatatctaaaaacctaataagggaattgaaaatggaaggataaaattctttgattatccccagagaaattagaacaagaggaatagagaaatagagattaaataggatacacagaaatatatgagtataggaaacttaaaactaaacttttcaataatttcactagatgcaaattaattaaacatccccagtgaataatcagttttagatttaaaaattgaagacataactgtatatctaaagggactttttttttttttttttgagttagggtcttgctctatcacccaggctggagtacaatggcacaatcttggctcaccacaacctctgcctcccaggttcaagtgattctcctgcctcagcctcccgagtagctgggcttacaggcatgcaccaccatgcccagctaatttttgtatttttttggtagagatggggtttcaacatgttggccaggctggtcttgaactcctgacctcaagtgatcctcccgcctcggcctcccaaattgctgagattacaggtgtgagccactgcaccaggcctacaagggactcactttaaatacagagacacagataggttgaaaaggaaagaatagtaaaagataaaccataaaacagtaagcataaaaaagctatggctggccaggcatggtggctcaggtctgcaatcccagcacttttggaggccgaggtgggtggatcacctgaggtcaggagtttgagacaagcctggccaacatggtgaaaccctgtctctactaaaaatacaaaaattagccaggcatggtggcgggtggcctataatcccagctacttgggaggctgaggcaggagaattgtttgaacctgggaggtggaggttgcagtgagctgagattgtgccactgcactccaggcctgggcaacaagagtaagactgtctcaaaaaaaaaaaaaaaaagctatggctatgttaatatcagaaaatgtagacttcgagataaggaatgctgttagaggaaaagagagatatctgataataataaaatggttaacttattagaaagatataaacatctatgtatatagtagctgagctttgaaatacctgaagtaaaaaactgacagaactcaataaattcgcagatatttggatattctaacattctcactcagtaactgttagaacaattaggcataatttcagtaagtatatagaataaagaacatagtcattgtgacttaattgacatttacagattactccaataattgcagaatatatatttttaaagtgcaagtagaactcacattatgttgacacataatataacaagtattaaatcttaaagattatgtcctttaaccacaagaaaattaaattagaaatccaaaacaataagatatttagaaaaagcataacatgtttagaaaataagcagtactctcctaactcatgggtcaaagaaagtacaggggtaagttaatacatattttaagctaaactgtaataaaagaacaatatgtcaaggctttctggatacagctaaagtagtgcttgttgagaaattaaagctttcattgtttaaatagggaaaaaaaggataaaatcaattatttaaattttttcttcaagaagttggaaaaagaaatacaaaacctctagaaagtagagaagaaaatgtgaaagaaaaaataaaatagaaaactgacaaataatggtgacaacttacataaatgaagagattcgatattatcaagatatcagttctccagcaattgatttatgggattaatacaaggtcaacgaaaattccaacaaggtggtagaaattgacaagcagattctaaaatttgcataggaattaagtgatcctagaatagctgaaacagtcttgaaaaaaagaacaaatttcaataacttccacaacctattttcaagatttactatgaagttacagcaataaagtgtggcattagcataagaaaagacaaataatcaacggaactcatttctgaagagtccagaattagacatacacatatacaaccattgatttttgataaagtaggaaggcctagatgaaattatggggaaaaatgaactttaacctctacctcacaataattaattttagatggatcatatatctaaatataaaagctaaaactaggaagcatgtggaagaaaataatggaaaatgttacaacttttgtgctggtaaagacttctcaagtagaaccgaaaaagttcctaccataaaaaaattgatcaattggactttatcaagataaaaatttctgctcatcaaaagacattgctaaaatgaatcatcaagggccaggtgcagtggctcacgcctgtaatcccagcattttggggggccgaggtcagcggatcatttgaggtcaggagtttgagaccagcctggccaacatggtgataccccatctctactaaaaatacaaagatgagccaggagtggtggtgtgtgcctgtagtttcagctacatgggaggctgaggcaggagaatcccttaaacctgggaggtggaggttgcagtgagccaagattgcagtactgcactccagcctgggcgacagagtgagactcagtctcaaaaaagaaaaagaatcgtcaagtaacatattagaaaaattatattcaattccatttgtgtgacaaaggacttgtatctacaatatataaatattcctacaaatcaataatttataatggacaaaagacttgaacaggcactttaccaaagaagatatctaaatggtcaataagcacatgaaatggtgcctaaaattattactcaccaggaaatgccagctaaaaccatactgagggaacattttaaaacccactggaatggttataatcaaaaaggttgacagcaccaaatattggcagggatgtaaaacaacacaaacgctcatacattcttggtgggagagagctctacaacaagtacaactacttggataattgtttgaaagtttcttctaaagcccagtatatagtgcccgactgcagtctactgcactcttaggtatttacccaacagcaatgaaaacatgtccatgaaaagacttgtacaggaaagtttatagcagccctactcataataccttcaaactagaaagaagccaggtatctttcaaccagataataaataattgtgatctattcatacagtgaactgttattgtgttagtcggtttgggctgctatataacaaagtgccatagactgggtggcttataaacaaaagaaatgtatttctcaccatttcgtaggctggaagttcgagaccagggtgtcagcatggttgggttctgatgagggccctctaccaggttgtaggctgccttctcacggtgttctcacatggcagaaagagggcaagagagctctctggggcccctttgtaagtgcactcatcccattcacaaaggctccccctccttgatctaacagctttcaaagaccccacctccaaataccatcacaatgggggttaggactttaacctaggaattttgatggggcacaaactttcagaccattaaagtgaacaagaaagaaggctgcgcttctaatacatgtcacagcagggatgagtcttagacgtgaatttcacacctggcatgaaggaagccaggcaaaaaggacgtgctctgtaattcagtatgtaagaagccccagagcagggagagaagtcagaacagtgattattatgggagggtgggggtggaattgacttgtcaggggaaatcacatacattgggaaatgagaaaatgtcttctgtcttaattggaatatatacatttgagggtatgcaccaaatgatcatgtatgtttgtcaaaagtcattgaattaggctgggcgccgtggctcacacctgtaatcccagcactttgggaggccgaggcaggtggatcacttgacatcaggagtctgagagcaatctggccaagatggggaaatcccatctctactaaaaatacaaaagctagccggatgtggtggtgtgcacctgtaattccagctactcaggaggctgcagcaggagaatcgtttgaacccaggagacggaggttgcagtgagccgagattgcgccactgcactccagcctcagcaacagagggagactccgtctcaggaaaaaaaaaaaagaaaaggcattgaactgtacatttaaaatctgtgcatttcaatgtatataaattttacttcaaggaaagaaaaaggggacatgtcttggcatgtgcctcctttcttaagcctattaattataaaactgggttacccagatcctagaatatggctatgaatagggtagctgtaagagccatagataagaatctggggacttacgggtgttgaaaactcacggtggggctgacaatgattataatctgcttttttgttaccatttcagattatgacaaagcactggtgttcatcaggaaactaatgggagtaaagggtaaatagcttagtcaaaaatgcagctctctctttcaacatattagcaggaggccattttctggttttgtgcgtcaagcacaaagacaagcatcctatttgtttttagaaatcacatctaactttctttaggaaaggaactttaattttatagcgaatgaaaaatatcaattaacctattaattaacccggagaaactattagcctgggagataataaaattgcttttgaaaagattacctgacaactgcacaaataattactcttgcaaacatccggtgttctgcctttctctctaagatacttgagagagtttaaatatcaaagaatcctgattatttcatgagtattttcttcagctgttataaaaatcatgcttcagtgtttcagggattttgttttgtgcttgtcttggcagtggggaggaggggagcttttgtgtgattccaggtaaaagtatgctactcacagccttttgtaggtcatggcttcttgagaatgtgtacaatgccacggagcctgtccccagatgcatttccatgtgactatacacatatgcacacaatcttgcatatgatttcagaagcttggtgggctgctagaattttgtctcagatcctctagagtctagatgatggaggctggatgtaagggaggagaccacccttcatactgtcttatgcccaatttctgcctccaaagaaagaagaagtaaaaactaaaaggcagaaatgaaatccacaggcagacagcctggtaccacacccggggcctggtagttaaaaatcaacccctgacctaatcggttatgttatctatagattacagacattgtgaaaatgcactgtgaaaatccctgtcctgttctgttccgttctaattaccggtgcatgcagcccccagtcacataccccctgcttgctcaattgatcacgaccctctcaagcggactcccttagagttgtgagcccttaaaagggacaggaattgctcactcgggagcttggtttttgagacgtgagtcttgctgatgctcccagccgaataaagcccttccttcttcaactcggtgtctgaggggttttgtctgtggctcgtcctgctacagatgggcagccttggttctcatttttcatgccatctcctctaatggaaacaggaatgatctccccatgtcaacacctgcagtgtgggcctgcatttgggagggcgtgtgggtgcgtgcgctggggctggctactggtgtgcattgcccagagagtttatctcagaagtctttgacaaaggcacggttggcttcattttctgtctgtgaattcaagtaggagacaaatggatttccttactttttctgatcctgtgtaggaactgtagaaaaatgggtgtttctccctagttagaaagaaatgcttttcccaaagatgaattcagacagctttatttaatggaaaaaaatgtcttgcctgtttctaaatgcattcttccctggtggcttatacctggcaaagagaaaaattagtctcttgactgaatgaagtccccgtcaagacgaaggaaaagagagaagtgagaaaagaggctagaagagccaggattgaaggcatcgtgctgggggtggggtgcgtgctgagggtaatcgttgcctggaggcacataggctagtccatcagatccaaaattccaaagcttggctgtgtaaagaacaacatctaggagtattgagaagcaatgtgggcagtgctgagattcaaaaggggcgtccctagtcccaaagacgagccccacccaagtgaatggacttcccgaaattatggtacctgtctgagcctcagtttctccatttgtggatgggaataatcacacaaagtattttgcagagcaaatgagaaaatgtttataagagtctggctgactgcgggaatgctgttatttttgagtttctcttcccttaacgatcaagaataattagagacttatagcagcctgggagaaagttatcaaagaaaggtgtactgtatctgcccaaattaacattaggatgtttcacgggagctacttatttcagaggaagagctacagatggtttggaagatgatgagctttggtgaatgctatgctctgagaatgatggaaaaacagatatgggagaaactagcaaagccgtgaagccattaaggaactgaccacctaaaagacagagtcaacaaggctgtgcaggtctcctagggagataagatggcatattagtcagggttctctagagggacagaactaataggatatatgcatatataaaagggagttaattaaggagaactgactcacaccatcacaagataaagtcccacggtgggccatctgcaagttgaggagcaaggaagccagtagtggctcagttcgagtcccaaaacctcaaaagtagggaaaccgacagtgcagccttcagtctgtggccgaaggcccaagagccactggtgtaagtctaagagttcaaaagccaaagaacttggagtctgatgtttgaggacaggaagcatccagcatgggagaaagatgaaggccggaagtctcagcaagtcggcttctcccaccttctcctgcctgccttactgccatgctggcagttgattacatccaatggtgcccacccacattgagggtgggtctacctctcccagtccactgactcaaatgttaatctcctttggcagcaccctcacagacacaccagaaacaatactttgcatccttcattccagtcaagctgacagttaatattaatcatttacagatggaaatagtgtggttcaaataagaacaagagcaccttgtgaaataacatatgtagaagccaaggcttgcaatgtacagtctagcagtggcctttcatggtagagagactcattcttgcataaaaatgaagatattcaattaacacatcctattggttgtattctataacagggtgagcacatttatttacttcagctaaattgaaaatcatggcctcacaatgtcacgtgtgtgtgtgtgtgtgtgtgtgcgcgcatgcgcacggtggtggtggttgtgatgaaatggaggaagaatatttgagataaagctaatctttgataaaattcctcctgttcagtggtgaaccaggattggagacagagaccaggggagctgccttcccaggcaaggagggcatttggtcactcaccttgtttagaactgctggctatgatacgaacacaaagcagactgacccttagtcagatctattattgttttaaattctctatagataatgtactgtcttatttctcacccctgggcagactgatcccaccaccaaccctgttctacctccaccccacactgcctctgggaatagcatatgaacaaatgtcattgttaattcctgatcagttgtggctgtgttatcaaagcaggagaatcattaggatgtatggattatggcagcttaaaaaaacaaaaactacatgagagacttagatttatgcttgcagaatgtccaaatgagttggaaaagtaagactaacaaatctagaataaaagtgaattgtctttgccaatttcactgccccatgggcagagtcaacagcaactactgtcaaaattgttcttgagatccatctgtccctagacataactataaaaaccttaactcatgggaagagtctacgtggcagctcctttgaaagctttccttgctgtttaagagaagtctagtctgccagaataaaaataaaaatttaaaaatctctactaagacaaattagaagataatgcaaggaatattgggtaaacatggaaagaagggctgcctgtaataagcagtaaaataatcttaaacattctgtgcagagtaaacgcatgtatatacaattaattccaaggccaaagggagtgagtgacatagagcgatcacatcattgtctgaggaaccattctctgccaagaaaaaaggcaacagtctcatattcttctctagattagttgactgtgaaaagaaaagagggcaacaagtcagcttcccttagagaggttgttggtgagtgggacatgtgttaatgagacacttcacaccttccctggtaggtacctggagcaggctgaaataagcaaaagtgaatgcaggtgatacaggtgtggggggtgaggggacagtcttccctacctgcaggggaaagcctgtcaagaaagcccttgcagcaagaaggtactcaaattaaataatgcttgatacatactacctacacactaaccttatggattagtatttttaaaagtctcacctttgcatcctgtttgtgagttagaaatgacttgactagacgtgatttcacatatcacgatttttaaaaatatttgcaattttctaagaatatgtatatgactaaacttatatggtataaaccatactggtaaacatgatgatgatgatgaagataatgatgattgatgatgacaatgatgataatgataatgtgctctctagaaaaaggaacaatattccagatattttaacatactgctactgaattagtccattctcacactgtgataactacctgagactggataatttatgaagaaaagaggtttaattgagtcacagatccacaggcttaacaggaagcatggccagggggccttaggaaacacaattatggtgggaggtaaaggggaagcaactgtgtcttcacatggtggcaggtgagagggagagcgagagagagcaagcgcaaagcaggaggtgctgcaaactttaaagcaaccaggtctcatgaaaactcactatcacaagaacggcaagaaggaagtctgtcttgatgattcagtcacctcccgccgggcccctcttctaacgcatagggattacaatttgatgaaatttgggtggggacacacagccaaactgtatcaaccacatttatttatcacagcagctattattatccctgttctatatagatgaagaaatgggggtttaacaaattgcccaagatgatagagctttgcccaatctatccatgtaccatcaaggccatagctttgcccttattttgcttgaagttgaaaatttcttttatattgttgtttgattttgttgtattacaaagccaaatctaaagaatttcactgtaataatatgcatagtaggtgtaattagaggtaggcttactttgtttatttatagatttagtttgcaatttaaaatccatgaagtgatagcatgtgtcatagcccatcatgaatttcgaatgaaaacactgtggctgtactgagcttctgagaaaaatccaagcgggtaagcaggagttctgagatggagatgcacaatcttaattacattagctgcctccttgggctattttgtgtatgtagtggggtgggcagtgggcttggttcttaatgtaatgagtgatttcaccaaggagggagacagggcttgacttgatgtgtatgggtagtaagtggattactagaagacttaagaacagggaggttagaggaaattgtcacattttcactgggttaggaattttaaaacaaaaatacgagcttcaatgagagaaggaacatacatggcctattttaatgatcatgagagcaagagactgtctgaagtaaggttcaattgcaagattcaaaggtaggacaatgagcatgttgaaagctaaggagaggaataagtgtaggaggaatacattattagggaaaaggaaacgcaaattgtatttcctttgcaatttgcaaaggaaaatttgcaaattttccttttgcaaaactaaagagaattgcaaaacgaaagaaaaggagagtgatgaagagaaccacatgggcaaaaaaataaagatgtagacaattctggatgatgttaacaaatgaataaaggcatgtgccagcagtttgcttagggcagctagtctattcagacagagagttacagggtccgtccgaggggtggaggcacaggcggctgtggtggaggggtgctggggctgaggtccagtgagctgcctgcctctgtgtcaagaaagaagaactgaaggtcacattctggaaacagaaatccactttcctaggggcagtgtgaaatgttaaaaggttttatgttatgccagagaggatagttagacaattagagttatctgaaggttgacaaggcagcaggcttagatgaattacactccagcagtgtggagaggaagcgccagtgaaatgtgaaatttggagaggctgagccactcccagcactgggggaaaggaggtggctctttgaattctgcggtgcgggaatggcagagcacacctggaagccaggagggagcaggtgttacccttgaaccaggcagacgtgggggaggcccaggcgtctcatctctcccctcctcctgccctgtgggaagagcatagtccccctctgcctttttctttccttttgtcttcagtccgccctccctgactagtacatggtcggtcaatcctgtcatagaacagaaactagatgtttccagaatttttatgccacagcgcttgaatgttctattgtttcacaatgctttgacacttagaagacaatactacatagtagacacttaaaataataggaaaaattgtctgtcaaataaatgacttagaagacctggttactatgtccaataaatacttggtgttttattttactcacccctcttaacttctccttgtttcaacacctataaaataagaagagtaatatctgcgctctttaccagttttcctgaagaccacatgagataaatatgtgaaaacacactatgaaaagcacaaaatgctttataacctatagcattatttttgtaagaatgaagcaaaactgtaattgtgtctgaaatctaagaatggatagagggaagatatattccactgtagactcgaacatgatttgattaaagtctgactataagaggagaaaccacttcctgatgaattatgagacccaatttaaggaataaattattggattggcttttaaaaaagtccagtagtggccgtaatttatcttgattagtggaaaggtttcataaactacagtgtgcaaaatattgatccatttagtaagtacaccatgcaggggcccctgcagaaggcaggcacctccagctctgcagagggcagcacagtggcccactgccttttatcacagctgtggaaccaaatggaaactggacgccgtcacggaaaacgatcagtctgcatgacgggcgcatggaaaggaagcctgacatttgaaaacacgtttcttccaaatatctttaaagatttctgaaccagagctcacccacctatctgtagcctccaaattatgaacagaatcatgacagaatttgggtttgtttcccagtggctctgccttcttttgttcttaaatattttttccaaactctcagatcataaccaaataacaaaggaagcagctgtgatgctcctacactgtggtaagtcccctttgagaatcgtcattgtggaaaggagagaaacttagattcttgattctcagtaggtcgttcttgatgaacacttgctaaccccaaggcattcatttactggagcaaggttttgtgcatttcagatgtcagcctgagattctggtaagatgttaggaagtgctccagctgggaattgccaccatagttccttctcagcctcactttagagaggtcaagtgcatctagaaaatgccaggctttagagtgacagcatgaaatacccccttgggttcttttttctttttctttttcttcttcttctttttttttttttttggagacagtgtgtcactctgttgcctgggttggaaagcagtggtgtgatcatagctcactgcagcctcaatctcctggactcaaacgatcctcccacctcagcctcctgagtagcatgtgccactatgcccagttaatttttaaaaacatttttttgtagagatgagttcttgctatgttgcccaggctggtctcgtgctcctgcccaaaagggatcttcctgcttgggttctttagcagaattccagaggctattcctacctgttgtaatgaaacttctcgatttgctctcctctccaaccacaccctccccatcagcatcttctcatctgccctctggggatgtggattcccttcggcctatgaaggcaggtctcccatttaggatattcaaaagcggtctggtgcgggtggctcatacctgtaatcccagcactttgggaggctgaggcaggtggatcacctgaggtcaggagttcaagaccagcctggctaacatggcaaaactccatctctactaaaaaatacaaaaaaattagtggttgtggtggcatgtacctgtaatcccagctacttggtaggctgaggcagaagaattttctgaacctgggaggcagagattgcagtgagccaagatggcgccactgcactccagcctgggcaacaagagtgaaaactccatttcaaaaataaacaaataaataaataataaacagaatatgcaaattcaactccaaacccaaatgaggaaggccatcaaataagatagaaggtaatggttcccactatttgagtaagacagccacatggggacaaatggcttgtgcaatttagtggagtaaatggcacggccacatgaccttgtttggcttctgttggttagcagagatccttggcatcagccagatccatttgttttcttgaatcttagcttttcctctcctttgtccccaaatatcaaagggcaaaccacttgacatcatttctagctgtcatttcccaatgcagtagttttaaagcctgaaaagccaaaggcaccactagaaattacatatattgtggggcaacacgtggaacttaaagaaagtgagcatgaggaggagaggagagatgaggcgaggcgaggggaggggaggcgaggggaggggaggggaggagaggatgaattgctgccaggtgctgccccacttttcatacctatccaagtgactcttccagattctaagtacattcagattgtgttttagtgaaatgcagtaaaacaaacagatgttaaattgctttcatacatatcttgttttatccccataacaattcagtttctggctttatcatacctgtttgagagatgaaaaaacaagactcagtgagatttatgctccccaccaaaaatcacagcaaattcaccacagaacctgaacagtaactgagatcccgtggaaggagagcagaccagggaggctgacgttgttataggagtgtgtgcattttacctattagttcaaggggttttgttggtgttttatcatgctccacaaccaatagcaaaagcaacaaataaatggtataggacagtgcaaaggaataggatcatacccaagtgcgttttaacaaaataagtaaacaatcagtaaaatgtatctgggagtgctggctccctcagggcccctggaacaggggtgcatagttaagaaatatacagagttctgctctaagaaaacgtgtattccttaaaaaccaccacattatacaaaatcacaccaataaaaacacaacagtaatgagagaaatggggttatggacacaacatttaaatatgttgtcagtgaaaaataaaaggaacatagtaaaaatcggtagcatagtttcacacaagttatatggttaagaaatacattgaaactacaagatatatggcacttcaccttgaaaaaagccccagagttcactcggaggagtaagagctgaaaaggctatagttgtgagtgtttgggaagaggtagaagcaaaggtgttgaaatcggacggaagtaacaccagacatggatgcgtgtggcctgtcacacgcggagaacccaggcagtggcagcttgatggtgtgcagccatgtgttttatgaatttctacagactcaattcctgggctgcaagcagtttttctgcattcacttagtgcttctcccagaccaaatcacacatatgcgaacaggaaattaacctgatgctcaaattgttctctaatctatcaattacattgaaacaaagtcacattttcaaagcaagcattttaacagaagtgactgcacctaggtcctccctctacggagcttacagtctccttcagaataaaatatggacaaataggaaatactggattcgtaagtgccaaactaatatgcaggtgttttggaaagggaggggccgctggggcagtcaaagaagtttgttgcaagaggcaattccggaagaaatgacctaagcaaagtcagagaagtggaggtaattgtgatgggagaaaagagaggaagaggtagaggacagagaggacagctgctcaggggtgaatgagaaacaggtttgagcagaagctgggctggctgtgataaatactgaggaatgtcactggaatgtcactgcaaaggaggtgttttttaatgtttgggtgtaaatcaagtctgtagcacagactgagggaatgaatattttacagaattgctgtcatcgttctgtatcttacagcccattctgttcatttctcattcaataatatttattgagtttctgttgtatgccaaacgcgttcacaactgtggattcagctgtgaacacaacgggtgaagcatctaccgtaaggagtggacatcctagcagagcaggcacgtggctgctggttaaggagacgggcacccagtgagctcaaaaagcagccagggctgcggcatgaggcagaatcaggagtcagggaaggatgagccgtggaggaagatggctgtctcagagagggtggccagagaggtcctctctagagaattgacatgtgaatcccgaggtgcccaaaaggagtgggagcaggtctcaaaaagttggtcccaggcaggggaagcaatggatggaaaaatctgacatgtggagaggcagccacaagtctgtggggtgggagcggtaggagaggatgtgggctggagtccatgggtaggagttggggctttatcctcagttccgtggaaagctgccaggtcatgttgagcaggagtgtgttgtgatcggattcactttttaaaaaattattttatttccataggttattggggaacaggtagtggttggttacacaagtaagttctttagtggttattcgtgggattttggtgcacctatcgcccaagcagtatacactgcactcaatttatagtcttttattcctcacccctttccactctttcctcctgagtccccaaagtccgttgtgccattgtgtcattcttatgcctttgcatcctcatagcttagctcccatttatgagtgagaacatatgatggttagttttccattcctgagttacttcatctagaataatagtctccaatctcacctaggttgctacaaatgccattaattcattccttttttatggctgagtagtattccttcgtatatatatataatacatatatatgtataatatatattatatatattatgtatatataaaatacatatatatgtataatatatatattatatatattcttgcaattgtgaattgtgctgctataaacatgtgtgtgcaggtatctttttcatataattacttattttcttcttggtaaatacctagtagtgggattgctagatcaaatggtagttcttttggtgtattttgttgtttgtttgtttgtttagatggagtctcactctgttgcccaggctggagtgcaatggtgtgatctcagctcaccgtaatctccgcctcctgggttcaagtgattctcctgcctcagcctcccaagtagttggaactgcaggcacatgccaccacgcctgggtaatttttgtatttttagtagagacagggtttcaccgtattggccaggctggtcttgaactcctgaccttgtgttccgcctgcctcagcctcccaaagtgctgggattacaggcatgagctgccacgcccagccaattcttttagttttttaaggaatctccacactgttttccatagtggttgcactagtttacattttcaccagcagtgtagaagtattcccagttcactgcatgcacgccaacatttatttgctgggataattggcaagctacatgtaggagaacgaaactggatcctcatctctcaccttatacagaaatcaattcaagatggatcaaggacttaagtctaagacctgaaactataaaaattctagaagataacatcataaaaacccttctagacattggcttaggcaagaatttcatgactaagaacccaaaagtaagtgcaataaaaacaaagattaatagctgggacttaattaaactaaagagcttttgcggggcaaaaggtaaggtcagcagaataaacagaaaacccacagagtgggggaaaatcttcacaatctatacatctgacagaggactaatatccagactctacaatgaactcaaacaaattagcaagaaaaaaacaaacaatcccatcgaaaagtgagctaaggacatgaatagacaattcccaaaagaagatatacaaatggccaacaaacatatgaaaaaatgctcaacatcattaatgatcagggaaatgcaaatcaaaactacaatgagataccatcttactcctgcaagaatgattcacattttttaaaagataattttgcttatacttggagaagctctaggggaaaaaactggaaacacaaagaggaggtatgggagagttgatggtggcttggacctgggtggtggatgtaagcagggaaggaaggaaggaagggagggagagagggagagagggagagagggaggaaggagaaagaagagagctggattcagtgttttgaagttaaagcccacagggtgcactaatagactgctcgtgaaatatgaaggaaagtgaaaattgaggataacttcagctctgcccccttccccagaactgagtagatggagatctaatttactgcgatgtggatgactgggagggcggagtgttgtgtggactccccaccccagattcatatgttgaagagctaattggttgtgaggacctcagaatgtgactgtctctgcaaatcgggcctttaaagaggtaattaggttaaaatgaggccatagaggtggaacttactctaatatgactggtgtccttatgagaagagaacatttggacccacagtgagacaccaggaatgcactgccacagagaaaagatcatgtgaggacacagtgagaaggtgccgtctgcaagccagggagagaggcctcagaggaatccagcccagccggctccttgatctcgggctttcggcctccagaactgtgagaaaataaactcctgttacttaagccactaagtttgtggaaagagagaactcaagggggctttattttaaatatgttagaaagtgtcaaatgaagttcaaaaaaaaaaaaaaaaagactagagactctaggttaagcttacataagagacccaaggacagcaaatcattttgttggggataaaagtgatatttgtaggcaataatgcagcttctctgattttgtactaaatacgttttagtaatttttttgtggcccagctgaggatagcttctcgagatacccttatggtttaactgtatttttcacgcactgttactggctaaggtcagtggatcaaagagacacagtagtctatgcacgtttccgatttattaggttacgacagtggggaaactttctccttagtctagtccatgaatctgctcaccaatgaaaaggaaatatagctaggaattatagcgttactgactccgtaatacttcaataaaatctgttcccagtttgagaaggagtcgggcaaacacaggaacttgcttaaggaaaataaccatgatatagataaccaacagaaagtctagagtaagaaacctaccccactccctttctagcagtgattgcctattacaggagaaaacagattggaagaacaaaggggaaagactcaacagaaactgtaatgtgacatagcttagtctcctgaaaggagcaaagaaaatcagctcaggagtaaatcaggatctctcttctcttgccaggacaaattcttcacttttaagatcaagattagggagctgattagaacaggttagcttctgtttatatatgagcagtttttaattccatagccattttagaagaaaaatctgagtaatcatcgcctcaatgacagaagctagatcaacctcccacaagctgcagctttagaatattggatggaaggaaattgatcctgagatgtggaatcccacaatattttcactaacaggtttccatgagaagtgggtgcttcattcattcttgtctacacacctatttctgcacttcctcctacaatatctcttttgagccagcctcagaccaaacacgactgcattccaaacagtcctctgttatgttctttttattattattattattattatttttgagacaaagtctcactctgtcacccaggctggagtgcaatggcacgatctcggctccctgcaagctctgcaacctaccaggttcaagtgattctcctgcctcagcctcctgagtagctgggattacaggtgcccactaccacacacggctaatttttgtatttttagtagatatgaggtttcgccatgtttgccaggctggtcttgaactcccgacctcaggtaatccacctgcctcagtctcccaaagtgctgaaattataggcgtgagccactgcacccaaccttgttatgttcttttcttggaggtctgtgggaactggtatgaaggtggtacactataaagaaaataacttacatggccaactagagttctgaaaaaccctcttctttaacacaattaaagctcattaaggttatgttgtgctgcaaagtggccttttcaaagagtgtgagaggtgcattttattcacatatatttgcactgagttcaagtatccctaattctcattatgtgtaatgcatttactgtgaaaagacatagaatattgaaaccacaacatgacatgcatacaattcataacaaagctttcaagctatgaaatatttcatggtaggacagagaagcacactccgagttctttgtagtagagttatttggtgtcacataacgattaagaacaatggctccagtcacaaaggcttgagtttaatccttgctcaacttttaattggctgttactttggacaattactctctcttaagcctatttccacttgaaaaaaatgggtaataacaatgtctgtcttgtaggattactgtaaagatgaaaattgtattatcaaaagctgagtatagtgcttggtatagagtgaagagggcccgcattggtatctgtgatgatgatggtggtgatggtgatgatgatgttaatgatgttaatgatgatagtgataatgatggtgatcctgatgatggtgttgatgatgatggtgataatggtgatgataatgatagtgatagtgacaatggtgttaatgatgttaatgatgatagtgataatgatgatgatcctgatgatggtgttgatgctggtgataatggtgttgataatgatagtgatagtgatgatggtgttaatgatgatagtgataatgatggtgatcctgatgatggtgataatggtgatgataatgatagtgatagtgatgatggtgttaatgatgttaatgatgatagtgataatgatggtgatcctgatgatggtgttgatgatgatggtgataatggtgatgataatgatagtgatagtgatgatggtgttaatggtgatggtgataatgatggtgatcatgatggtgttaatggtgatgatgatggtgatgatgatggtgatgataatgatagtgatagtgatgatggtgttaatggtgatggtgataatgatggtgatggtgataatgatggtgatgataatgatagtgatagtgatgatggtgttaatggtgatgatgataatgatggtgacagtgatgatgttgatggtgttaatggcgatgatgatgatggtcataatgatgatgatggtgatgcttctgatgctgataatgttaaactgaaccaagtctctctgaaatgaaatgtggtgcagccttcttagatcattgggcaaaaagaaggcctctcaggacatgtttctgctgtagcttgtgccactcaagtccttgggatgctttgtaataagaaatgaaagttagctgaatgtattttacagaaatgcaccgtttaatactcccttacataatgcaggatcaggagatatagaagtagacaatcatgttgtaacttttaataaattgttcaatcatagtattcaatgctgctgcaccattgattgtattagcaagcatcaaaaaaatccttaaatgataatgtagccgacttacacaaaataaacttaagattactgttttggtcaaagaattttcttgggtcagtagagggagatgaggaaaagaaaaatattttattatattgtagtatattaaataggttttattgtatttctttttaaaaaaatatacaagtgagtattctctcaaaccttagactttttcaccctggcctttcattgttacttgactggctgttactttggtcctatttttaactagcaaaagatcagacaaaataaagggaagaaaagacaattatctaaaaatgcaacatgtacaactgcacagtctagaaataacttgggtgtccacatgtgaggtaagcatctggaactagcaaaccatggtgagacattgtagactcatccccctcccattatggacttgacctcccatcccatgctcctggagatctggtctatgatgagatttctctcatatctctatgagagatactgttgtcgtttccttctgagtatctataggtgattaactaaaccgatcagactgggaactcctccagtgctacactgtgtacactggttgaataaatgaatgaacatataaaagaacaaatgaaaccatatcaggggtgtcctcaatttggggagatgcttgaaatcaatctgtcttatgaaggaactaggaagggttacagtcttattcaccaagatctggcgcaggctttgaaagaagggacacctgacctcaggtgatccgccagccttggcctcccaaagtgaccccatctctactaaaaatacaaaaattagctgggtgtggtggtgcacacctgtaatcccagctactcgggaagctgaggcatgagaatcacttgaacctgggaggcagaggttgcagtgagtggagattaagccattgcactccagcctgggtgacagagcgagattctgtcccaaataaaggacaaagaagaatatttgttcattctgtacacttggccagagatgtttttgactgaaattcattggttaactaacagtgcttactgggttttatcacataagttcatataaatcaatcaatatgattacatatctgttcaatgaaatgattccaccagaggttctcaaagtgtatctgaggaccctgggggtacccagcacctttcttaggacatctagaaagtcaaaactattttcataatgatatcaagatgttatttgccttttgtactttcattctctcatgagtatgaaaaattaatcaatttggtttcagagtgcacattacaactaaccttgtcaggttttgatatagtatcaaataaaaatattcgcagttatctgataaagcaattaaaacatcctccttttccaactacatatttttgtgagactagatttcttttatatacttaaaccaagagtaatatattgcaacaaattgaaagcaaaagcagatgttggaatctggctgttttctattgttttccttcttctattaaagtcaaggttactaagatttgtagaaatctaaaacaatgccactctgctcaccaaatttttttgaaaataattttgcataaaatgtgctgattatagtaagatataatagattttcattttgaatacttaaatattcaacattttttcattttattattgtaaatatacaataattcacaataatatattacaatatataatatatatttacaataaaattatatatttactgtaacaaattatatatatatttatcccttatatatattttatatatatcccttatacacatatacatatacatgcacatacatatataatgtgtgtatatatttatctcttataaacacatacacatgtgtacacacacacatatatgcacacatacttatatatgcgtgtacatatttatcccttataaacacatatacacacatgtacacacacatatgtgcacatacatatatatgtgcatgtatatatcccttacatatacacacatatacatgcacacatatatgcacacatacatatatatgtgtgtgtatatatttatcccttataaacacatatacacacgtatatgcacacatacatatatatgtgtgtgtatatatttatcccttataaacacatatacacacgtatatgcacacatacatatatatgtgtgtgtatatatttatcccttataaacacatatacacacgtatatgcacacatacatatatatgtgtgtgtatatatttatcccttataaacacatatacacacgtatatgcacacatacatatttatgtgtgtgtatatatttatcccttataaacacatatacacacgtatatgcgcacatacatatttatgtgcatgtatatatttatcccttacgaacaaaagctctttggggtcctcaatagcttctaaaggtgcaaagggtttctgagaccaacatgtctgaaagccactgaattaccttaacagctcctaggtctgaaagtttatggttctaaaaaatgcccagcacttgctgtttctatgaggaataaaagtgattgtctcaccatcaacactgtctacaacactgttagggagacaaagcttatctacatcaacatgatggattagctacttttcttagttctttctagctcccacaacaaaataccgtaaactgggtggcttataaacaagagaaatgtattgctcacggttctggaacttggaagtccaagatcaaagtggaaacagattcagcatctggtgagggcccgttcctcattgacagtcatcttgctgtattctcatatggtggatgggactagaggtctccctctgggatttcctttataagggcattaatcctattcaggaggtaacattcatgacctaaccccttccggaggccttgcctcctaacaccatcacattgaaggttaggattctgacatagggattttggatggatgcatgcattcagaccacagtgacagcctacaatcaagttctaaattgtgtagttcaaactaggagaactgtgaggagatggttttggggaaagtgacttctgcatttgcctcaatgattttccctgcgatgacacgtggcctgctctgaacagtgtttgttccacaaaatgctgctgtcctttattcagaaactttctattgaaaccaatttttatctcaataacctgatttttaatctcacaaaactggacctggtgactttgaattactatattagaaccttgtaaattgccttgtttactgattgttttaacacaagatcctgtcatctcactagactatgtaaatttgcagataaaaatgcccatcttagattggtcagcctgggggtgaaaatggactcaaccacttctatctattgattaaaggactctgagtaagtctcctaagtatatgtttttttttcaatctgtaatatcaggatgttagctgtcatttttaagcccctgtgatatcccatgtgatccaaaagacactttgtataattcatcaattctcaaaacaacatgctgagataacgtaattttcattctctataaatggggaaaccgaagatcaaagaattgaatcatggctaaaaccacacaactggtaagtggaaaggagttccacttaaattgaacttataactttgatctaagctgtctgattctaaagctagtgattattttcctattattttgatggtcagctcttaagagttcttgcaatagttgaataaagtgaagcctgtgatagcctagtgcgatgtcaggtacgtagtcagtggtcactcagccttggttccccttgtcctgcccttctcctgggccacagtgctttgtagagctgtattgtaccatcccagtaggtttagccacacagagcccatgagaacaagctttgcacttagatatgctgtccatgtatttgacaattgatttgctgtcctgactttgctattacctatcctcctgatcatggacaagttcctccgcttctctgggctttggctttcttttctgtaaaaggatgaatttggacaagattaccatcagatctatagattttctaccttatagatctgtactattgctgagatttttgtgacaagcttaggagttccccaaaataatgaaactgtgctatttgaacattttctctgaatctcagaggtacaaatttggaaatctacattgtcattaaggaaatgtgatgtataagaaaaacagtaaagtatagctgccgtataccgtacttcttaggtataaaattcatgctataaaatgactttcttcatctggtgtcaaaccctaaataatgggaaataatgcaaaggaaatatgtttcctgatagtcaatagaaggaatgacggacccagcagccatgtgagggtatatttaaactaagaccttcatttcatgcttctcatgattctaattctcattttcccatcgagttaaagggggaggattgagtttaacatgtgggaagagtaagatgccttggttcttccattgttagttttccatattcaccatgttgtataatcattaagcgtatttaatcgtggttattgagttaaaaatgaagtgttaccacccggttttgcagcatgtgccgtaattgttaatctggttatgccaggttgctatgcataaacaatgtctcacatcaatttagaaaatatgatcattactgtttatgaactgataatatagaaaaaaccatttagaatggatagaaggaaaatatcatttttctaaagaaaagcaaaagaaaacatgtcgttggcagagtaacaacatgaatcatagaatctagaagctcgtaagggtctgagaaaccatgggctccagctcaccaagtaccagaatgtgaagtgatgtgtccaggtgccatgtcccccagaggatgctcaggtctaaggctgaaatggccaatctgttcagaagcacatgggtctcctttcctaataaaggaagtagctaagatccacccttaaggcggcaaagtgtgtactaaggcatcaaaaggacaagtcaggtagtgagtaggtcacttattaccagactcaataccagtagctcctgcagaacaggggatgacttttcctctgaaaacaagagtacaagtgcctggtctctgggtgtgcctatggggaaattctgccctggttctggggctcagtctgattccaaagcacacagtcctaagaatggggctttccacgcctcagcccctgtgtcttcccccttcacctcctacaacactgccccagtccgtgtgggtcaactctcctttttctcaaaagccttcacttctaaaagcaaggttgtttattaagttaagtgacaaagagatactgcaacaataataagctgtgatcaaagactgggttgatgttccacatcacaagcactttcattggaagtttctaggattccaggatgtctgtttctgtgaatcccactcagaagactgtgtcttcattaatcagagagaagacaatgcaaaattttaagctctggtaatagtctatgtaaactgactattgtccatttattttgtctctactgagtttaaagattcagtgataccccatttatgtgtcgatccaatcagacaggtaccagaggtgtctctctctggggtagcaaactcagaggggacaaaaatgacagctctactattggttgtggttgcgaacacatatattgttgcaaagaggaagagcctattgaaatcagacgtgggcaggtgttgagttctactgtgatttgctattttccatcatacagagcaaggacaaccagaactgcaaagacagaggccagcagtggtaatgaggactgaagagaagtcccagcatggacaggaggcccttatcatttttaaacagcacaattccctccatcttacctttggcactggagataaatgaaataggctgttctgtttgaaaagagtgtacctgctcagtgggaccagcaagcaccatgtggccatactgtgacagtcatcaaaagaaagagtgcaccttcctttgcagtgataagggggtcacagagaaagcctgggggtcaaagctagatacaaggcatcaggctgccactctcatccagggacacaaacattcttgtctccaatattggatctgaaagtaaaatcaacatattctgaaggaaaaggatccagtgaaggaggacagtattattcagggaggccttgctatacctttatctccggggtttcctgccttacaggaagatgttgccttatagaaagatttatgaatgagatgctttgatgaaagtctgtaaccaaaactcttagctatgtggatggataactatagccagcttcctggtttcaaggaaaaagttctcaaaactctctctacattttgcatcctgaaataatcaatgtatctacctccctggatagacaattagcttcttgagaacaagtaccctgaattgttcactttcaattccctggctgccagcacagtgccttgaactgaactgagcttctacctaagcatctgtatcttctgctaaaagagacctgcctgctccatccatttttaacaggactctttcctaatatttgcttttaattaaatggaatattcatcaaagtgaaaaacatgcttcacttagtacattacctcagactacagagaacacacctctgttacttcttatggtccttttgggacagctgtggatttagtttcatagactttattagcataattgaaaaagacaatccgaggggaagcattttgtgcaccgcctggatggaaattatatgaaggtggcattaccagtactgtacttgctactaaaatttcacctaaagactcattgcaaagcacttgggcaaattttccttttctcacttggaattcaattttgaaaattgggggatgtcaagaatttcactgaatgaggttcatttttaaaatcccattatgagagggcagtgtagggggactccattagccccaggagtgttgaggggaaacgtaaatgagtgaggccattaaagtccttagaccacgggggcctcaatagagcctgagatggctgctgaggaggtggagacatggtcatgataaggactgactcccagcccagaggatgatgagctggtgcgtgttctcatgctgtgtcaaacctccttgcatatcaatcttctgttcaccctcacagccaatcctgaaatccatcctgtctccacatctgtggagtttcctgttgcatggagctcctcacaaaagtctactttccaagacagctttccccaacccagaatgacagtgggattcacacattatcaagaaaagtcacccatttcattttgttcccactggagtctcttttatcacttccctcacaaatgattctggggatatttaaactaattttctagtgtagaagaatttaatggatgtgtggacaccatgaatacagctgctgctcagtgcctgtacttgcttttgtccccaggaattgatttgagtgcaatcaatttgcaattcccaataatgtagagagctgcctctttgtctcagcatctgtcctgctaactgtgaggcccgacactatggtgaaggaggcagaataggaaaggaagagcttctggcatgagagacagaaaaagcttcagatggaggatcaggaccacaggcacacatcccctaaagatcatggaaataatgacaaaatacaacctgcgttacagccagctcccctagcaaggtgtttattctgtgcaacaagacacgcttactctcaccattaggatcatcattagctttaaaattgtcaagtgacaattacccatatattgcggtgatacactttttatactgaagcaaaatacagtcttatggatgggttattttctgtgtaacaatgcacatcattctgcaagatgaccaaacaggagagaaaacaattcacgttctgtagattacttgattgtgccccattttgttaatgggcagtatattttaaactacaatttcaaagtcaaatgtctgcattggttgtttctttaagtgtaaagagatcagaaaaaaagggtttattccttagaatgagtttccctgagatgtagcgaggacattatagtcagactggcacaagcaaagaaacagttacagcagcaccaacaattaggagaaaaattggactccaagtgaaacaatgctaggcgtctcactataaatgctatcaacactttgtgtgagacaggtgcagagtgtgaaagcaatcattcgtacagataatcactgtatcaaatgcgtgtccctgcctggactgcacctgccacaccttttcataaagccaggaagccagacaacagtgtcttgttgagggttggctgtaccatatgggaactgtgagccctgcaccagcatcaggtggtgcttctgttatttgctctctcactgatttagaggagtcctgagaaattgaggtcctcaacagaaaacacatgggtcagtgttaattcatctccagtgacctttgctgctgtggaattctgtagtcctgtctctgttccttcttttatccaaggcttctcattgcaaaatggaaaccgtattgtcaggttctaagttctgagcagcattttgattgggattctatagttcctcagtcatatcactattcttatcatggtgataccaatacaattattacaaatgcaaatacaacccccagttttcctgcaatagaatatgtgagccatttcacactggagttgatctacataaagtcagctgattctaagagctcagatccatacacccgcccctgcctgtcaacatggccactgaccacgctaacacgctgacgaggtgagtccttcacctcttggcaaccagaagtgttagaccttgaattttagcatttgctgaatggagatgcttccatgcactttagaagatttgattcttctgcaagaagaattctcctgttaaatatgcaaaatacgttttttttcttgttctttggcactagttaccaaaatctgcaagtctgtctatttttaatgtaccttcttttaaaagcactgcagtgcctatgtgtatattaggctctaaacctggctctgggaggtcatgagtataattttagacctagcaagttctgaagtcactgtttctcttgtatttcacaatgaaatgtcaggaataattttttgaaaatgaagtggaaccttcttttaaatacgagcccttcatctccatcactcctcccaggctctgtcataatcacaggccgggagctacatttctggctgatgggatccttgtgcagttggcacaggctctgcccccatgcctctggaccctcagctgtccttgcacacctgctgcaggtgcactgtcatgctcagggcagcacctgtgtcctttcattggcacttccggcacgctgccagagctcttactgcccgcctggcctggtggctggaaatgcctggggattttgcccctttgggcagcctcagccaaggactgccagatgtggggaaatatattccagcctcctttccccagcagcagctctgaaggatggcctacctgctcctagagtcctctgcagggctgaggcacagttctacctgtgtgacctccttccctctgtgtcccctccccatgggtttcccttgaaacacatcttataaaatcacttacctagaatacacatttaagcctccttctcataacccaacaccttggcccaaagagcggaacaaagagccggaaccctggggagttgtagcctatggacaccaggtctcggggcctctcctttaaggatatctcttttttccaaacagagtttaaagatgtccttgttccaaattgagaagacaaaaagcaaactatgttgcaggttttccaaatgatttcagaccagatttacaatggcttgctctttaaaaattgaagaaattcacccctggtatgccaggagcctgggagtctgcaccaggattgtcccctgcagatgtgaggacagtttaatcagctccctcctcagtgctccatactctgtgagacgttgtggggaaggcagcatttaaatctacaaataaaagtactggatccctcaagaggaggagagagtggtacaaccttaatggccttaaaggccaagaacttaatggccaagaagccagacatggagatatccatggccattctcaccccactctttccttcccactgcaccagcccctccggctccaaatcaaatagctctgaattcagaatgcaatttgaaaacttgggaatcaaggctcttctctgtggatcttgtatttgagatagtaagaccttgccagtgccttgaagttatctatttaacctagcatagccgtcactttggaagagtgaggccagcactccaggctacgctgtgcatgagaatgaggacaattttgctaaaacaatacaatgcttctttactgagggtgggtctattttgttttaagcttatggatattatcttacaaatacctgttaaaaccccatgcgtagttaataatcccattttagaaaaaaagccactttgacattgaattgctaactgatttttcccaaggtcaccccagtaaaagtgtcagattctgaaatcagattctgtgctacttgatgttaatgccccgtaggcctctcaatcataaaatgccttagagtcacagtgggtgtgacatacgtgaagttgaggaaagaacatttcccttttgacagccagaatagaatcgtttagcaaatggcattgataaggtcaataattcaaatgggaaattagagtattattctgacctcacaatagaattgattaggaaatggcaatgataaggtcaagaatgcaaatgggaaattaagagtgttattctgacctctagggtagagaatgggacctctgctcagctttaagtgaggagcaagacagaatagtgatggtgagccctggagatgcagtcagttcttgctgttcacagtagtcatgctctataaggttgccacaaaggcagaattaactaatactgagctgttgctcctagtggaaatgtaaggttaggttccttcaagcctcgggtcacaacattttcatccacagatccacacataagtttcttaagtgagcatttctgtttaaaaacattgtattacatatatagtcttcattcattaacactgatttcatggccaacggtactataacacatgcctgcatgaagcttttccaacacacatattcttctccataaggcacatcacggtattcttgtgcttgggaaccctacacagcacttcagcacgcacttgggggccattttaaacagcaaaatcaccaacaaaaaatacaaaaatgtggaactaaatagaccatgaagaggacacttgtttatagtatgagctaaagcaagaaggcagagtgccgtcatgttcagacccagctaggaacatgtgtgtcaggcaactcacttttttttccactgtgtacatgactgcaaaagacctggaaagcaccatgagtattgatttgcaagttacacataaattttaggagtaggtcgatctgcaaatattgcatccatgaataataaggatcacctctgttagcattagcacattgcccattgacaaatctactggattcatctgagctagtaaaaacaacaacaacaaaaaaaacaattgtcaatcagaccaaaggtaatctccattcgtacacaaatagaaggaacaattagcttgggaagatctgcctgtttatttaattaaaaataaattttaaaagatggaaggctgggcatggaggctcacgcctgtaatcccagcactttgggaggctgaggtgggcagatcacttcaggtcaggagttcgagaccagcctggccaacatggtgaaaccccatctctactaaaaatacaaaagattagccaggcatggtggctcatgcctgcaatcccagctacttgggaggctgaggcaggagaattgcttgagcctgggaggcagaggttgcagtgagccaggatcacagcactgtgctctaacttgggccatagggtgagattctgtctccaaaaataaaaaactaaaagaaggagaagaggaaagtagtcttctctctcttgctccagcagttctgaatcacctttgtgtagtttcttgatgttcttgcttttcctgtgcaaatgggtagtgaccttaacagtgcatactgtgctgaaactctccccagtgagagttcttccacatattctgagccatgctgaataatcaggcaggtgcacggctttgcccacactcaagtgaggaaggaccatgggactcttcccgtcatgcgggcgacagatgtggttcagccactgcaaaataaaaagccaggccctctgtataacgaaattcagtgaccactttgtttcattaagaggcagtctgttctgtggacctgggagggagagacagggagcgtttttcaccaacaacttacaactccacagtaagttgagaggagtcccgactccatgctgtatgaagtccagcactgacacaccatggccagcgaccaacttgctaagtcaaaaaaatctaactcagaaccctttgactgaggaacagttttcacactccagaaaattctaaatgactttcatttgctgttggttcacatgccctcgtggaagactttgcttgctgctttgttttcataagcagcttgaaggaaactcaggcaggaactatggaactccagctgctgctgtaactgcatcttgacgatgcaaaatgacgatggaaatatagaagcatgtacatcatatctatcatgaattgagcatgtgggtctgttccctcgaatgaaaaatacatgcaaataaaaatatttggctataggtggtgcaacttttaacagttgttctagaacttacacatccaaatatgtgttttcactttgcacagggtggcctatggagttttatgcttgctctagtaatgttgtagtggaaaacattttggaagtattttaatgtattaaccacattgtttaatatctttaacctcattaaatcacagtcctttaaggaatgatatgtgtgcactcttgtatgtgtatgagtgtatgtatgtgtgtgtgcagttgcatgtgtgggagtggggatgcacgtgtgtgtttggtgtgtgtatatgagcatgtgtgagtatgtgtgtatatgtgtgtgcaattgcatgtgtatgtatgtgtatgtatgtgtgtttgttgtgtggtatgtatatgggcatgtgtgtgtatatatgtgtgtgtgcagttgatgtgtttgggggatacctgtgcttgttgtgtggtatgtgtatgtatgggcatgtgtgtgtatatatgtgtgtgtgcagctgatgtgtgtgtggggatgcatgtgtgtgcattgtgtatatgtgtctgggcatgtgtgtgtatctatgtgtgtgtgcagtttggggatgcatgtgtggtgtgcatatgtatatggacatgtgtgagtatgtgagtatatggtgtatgcataattgtgtgcatatatgtgtgtgtggcatgcatgtgaggcacgtgggggtttgtgtgtgtatgaagaacaaatcatttggaaacaagtatggtgaatccatctaggtagtttggtgtagggttaaaaaatgattataaattttgtgattgattttcttattggtccaaagactgattctggccagtatattctaggactacccttggtggtggtatcatggggataaaaatgtggctttctgagacaacgccttggaagcgtgtcacttgctggaacataggcatctcagtacagcaatatgtagagtagcacgccatgcctgtgggcctttcaaaagtcctcatgtgaacgtgagcctttcttcctgtggtactgatgatcattacgttcacgttgcaaagtctcattagtttgatttttgaacccagttgttggaaaagggtgttgatgtgtcccccagaaatggggaaggtgctgaatggaaacctaacttaatcgtactgtggattgaatgcgttgcctttttaaagaatgtcttggcagttcccgtgattttgtctaactctctggctattttttcctctctggatttagctctaaatcaaaaacccacacacaattactgcacaggggatgacccttctcagaaaaattccaaaacctctggagtagattgggtttttttacccattgagataaagaaggatattacaccatagttttgaattacaatgctgatatcctattcagggcttattaggatataacttgaagtaaatgttgagagtaatcagcaggacattttgaaagaaaagttacagttaacctagatgacagttaaacaattgtttatccccgataactgcattcagatgggccaatagcagaagtcactctgaaattcatgaaagtgtaactaacaggactgtcactactgcaagcagcatatttaatgtttttactgtttttttataaaaaaaggtttctattacagtgttcttgagtattggactaaaatgcaaacgtcacttgtaaatctattcctttgggcttcatgaagatttgaggtaggtgctcaggaagtgaatctccccaagaaactcctctcttagaatacactctgaccccaagcctgttggtagcaagactgcaggagcacatggctttgcaggcagcagaccttggctcatacccaaactccccactcactgaacctgcagcctcccccttccatcttcgacttctttatttggggaacagccacaataatgctggtggctgtagggactggggacaacatatccagcgcagagcttggttttattagagctatttaataaatgatggtcacaaatatgactattaataattagctattaattcaatttacacttggatttaattaataatagtaataagtgggtttattgtcactctaataagaacatatttgcaggctaaaacatcactcccaggaaaatcaccgtgttgacatatttatcttttcttaacattttcttctaccaataacgcagtgtaagaatcaaccttaatagatcactcactttgtgccaagctctgttctaagcactctgaaaatattaacatatgcaattatcgtagccatcccacgaggtaaccattgttatcccatttttccacgtgaggacactgtggtaggttaagacacttgatgaaagctggtaagtggtagagatatataactgttaagtaacaagaacacaattttatttcttattttatttatttatttatttatttatttatttatttatttattttttggagacagagtcttgctctgtcacccaggctggcacacagtggcacaatcttggctcactgcaacctccgcctcccaggttcaagcaattctcctgcctcagcttcccaaggagctgggattacaggcgtgcaccaccacggccagctaattttagtatttttagtagagacggggtttcactatgttggccaggcggctcttaaactcctgacctcaagtgatccgcccgcttcgacctcccctaatgccaggattacaggcataagccgctgcgcccagcctaagaacacaattttaaatgccaggattcatacctctaaataaaatgggtgcatcctctacaaggcccaggatgtggtgggctctccctgggctgtgactgtgtcttccttgaattgtcttcagaatcattgataagtcccacgcctctgtttcctatctccattgtcacagctgatttatgaacacaaacagtattgcaaaacttaacaccaccactgtttgttgtaaatttacataccttgtgactcatttttaaaaaatcaaatatagcaacaaagtacaaagatttaccaccactgactatgtaagagaaggcactaggagatcttaggatattatgctaagtggtatttcaaaggcattttgtatcttagtataagatctctggtgtgcaattttgtgtgatttgaatagggcctactttgcaaggggccacgcagacggatttcagcatcagaattgatttataccagtagcctcttctttatggtcataccacatatttagaatttgaactttctctgatgcagtagactgcatcttgctacctgagaaagatacaaaccaccctcatcttggcctgaaaagagcctctcccagatgctcagcatccagtacagggaagaagatgatatggtatggggggtttggagccaaaaattgatttgagacatgggtctttgtgactctagcttagtgacttaacctttcaacacctctgtttcctcccctgtccaatggggagattgacctcacctgagagagtgtcctgagaaccaagtgtaatgatgtgtgttgaggggtggggacagggctggcacagtgcctggcatgttctaaccatctataattttattcttttttcccctccctattccattctctctgtggccccatagagaagactccaatctgtggttttcattgatggtggcagctttagccaggcagtggtttccctgttgtacaattcaatagcctgcatgcagggacatgcttctcaggtggcctctggatacacgtgtcctttgtggcctacagaagactttcttacacagtgcactgttaactgagcagaggcagccgtacctggggtgctgattagcactgtgcaatgtactgattggtactgtgtaatttttaggacctccttttgttccctacgccccttgggagagtgtggcacactggaagaaagacacgctgtatcctgggcacaggtcttctgttagactcaatggtgggaaggggatgggatgcagcccagggcctccctgcccatggcattttctcaggagctgtctcctttgagttgctatcaaatcgcatatgttgcatgcttacttgaaaggaatttgcacagagtggtttgtttatactagttaggcatcaaaaagaccattgttctcccagactttcagtataacaaacaaatttaaaaaaagtatgtatatttgggtagataaatatagggttgattcctaaagggtttagaaataaccacaaataggcccatttataacaagaggttgaaggagagattgccactctttggagccacatctgaatgccagaagttcccttgacatcctgctcagtccaagggtcacaacatgtctgatgcctagctctggactcaagggcatcagacatcagaacacgtctctctctggactcagggacaatacccatacatatctgtggaatcaggataccttacctcctatctccagttcctaccccactgtgaagctcagagtgatattgagtgagccctttctgaatcgggaccagtctcatctcagcttattacccgtgggccccagtaatgcaatctgttcaccttctgaacactgggatccccgttgtcttgtcctaggtcactcatttgagagacagaagcgagtagaggctgtaagcatgaactctgcagccacagggttgctttgaatcctggacttgacacagctgtgtaaacttgagcaagttattgcaactctgtgtgcctcagtttacctatctgtaaagtgaggatacaaatgatctacttcatagggctattttaaaaatagttaatatgtaagtaactattagaatgcctagaacacggtacttgttagtaagagttattcattgtcatcatcatagtcattatcatcatcatcatcaagaatttgatgagtacctgtaaaggctaagcaatatccgaggctcatggggtacacagcaataaactaggcagggctctgttctttgagaaacttactctttatttgagacaaacaataaagagagctcttttagcacaaggcactgtaggaattccagtaacaaggagtcgtcctatgtagacagaacttgtgcatcgttgatgatctcgacgatcttgctaaattgaagcttggatgggcaagtaagactcagactttactccaagcaattccaagcatatgaaagcacgatgggcagatattagcctgccatccatacacagtattggatatcgcactctctgtgggacatttgctccttattctgacatcataagaacagaaaaccagtgcttctggacacgaatcatttcagggctctttgcagatgcatagcatgaaagcagctgtttcagaattcaaaaattatacatcatgccgtatatggcttttcgctttacaagttgctttcaaacattgcctcatgttggcctcatgacatccatgttagataagcgtggtgagaattacttccctgtttgataaacggggaagctgagtcagggggagctgcctcatcatggtcactaaagagaggcgagtgagacctggaaccccactgggtcttctgtcttctgggtgagctcttggttgaggggactgtgagatgcctgtgtaggtgagtctttgctgatttatagactcaatggactaattgttgctggatgctaccagaactatgaaacaatctgcaggacgaaaaagcagatgagtcatgcaaattttaacaaattagttatgtttctgaaattaaaagtaggtaaagaacacaaaagaattggaaacaaggactcagatacttatatgcctatgttctttgcagcattaacaataaccaaaagggggaaacaacccaagtgtctatcaactgatggatggatcaataaaatgtggtatatccgtacaatggaatattattcagccttaaaaagaaatgaagttctgatacatgttacaacatggatcaatcttgaaaacactatgccagagactgggcgcgttggcttacgcccgtaatcccagcactttgggaggccgagacaggctgatcacttgaggtcaggagttcaagaccagcctgaccaagatggtgaaaccctgtctctactaaaaatacaaaaattagccgggcgtggtggtgtgcacctgtaaccccagctacttgggaggccaaggcaggagaattgcttgaacacaggaggtggaggttgcagtgagcaaagactgggccactgcactccagcctgggtgacagagcgagacttcatctcaaaacaaaacaaaacaaaacaaaaacattatgccaaatgacataaactgaacaaaaaggacaaatactgtatgaatccatttatgtgaaacatctaggttagctaacctcatagagacagaaaatagattagaggttaccagaggccagagggaggagaaatagacatgtattgcttaatgactacaaaattgctgtttggtgtgaggaaaagttttgaatatagatgttggcaatggttgcacaatattgtgaatgcatttattgccactgaattaaacactgaattaaaactgcttttatattttaattatacactgaaataaaactgcttttaactagtttattttaattatacactgaattaaaactgctttttactagttttatcatatatcatactagtttgttgttgttgttgttgttttgagatggagttttgctcttgtcacccaggctggagtgcagtggcgcagtcttggctcattgcaacctccacctcccaggttcaagcgattctcctgcctcagcctcccaagtagcttggataacaggcacccgccaccacacttggctaatgtttgcattattagtagagacggggtttcaccgtgttggccaggctggtctcaaactcctgacttcaggtgatctgcccaccttggcctcacaaaaagctaggattacgggcatgagccactgctcccaccctcctactagttttattatatcattttaggttattataaaatcacagccatagtaacttcctgtgaggaaacggtttaaaaatatgagagcaggccacatggccacctaaggaaatttatacattttgagaagcgtgaaagcttattctatttccctgagaaaaggtattgatatcacaatgcagaggtgatcttattttaatttcagcactattactgctgtgcatttattacaatcaggcagagtactgatgtgtttcgaatacgggaaagacagaatctgaaaagagatagcaatttaactttctgcaggaaaactccggcgtgtttttcattctgacaacttgactggtgataagaaagatgaggtactacttttgtaaacttgttatccttacactctcaagaaccatttgtcatccatttttccctgtcatactgaaatatacctctaagaaaatatcggtaatttctcagtattttaaaaacatagattctcttgatcagtctactaaatatttcatagtttgtgtgttgttcattagaaaagaagagattccattttcccaaactgtggaactgagcagcgcactgagattttaaggagtgggatgtgggtaccctgagaagggacatggttttgtccagagctgaggaaaagaaaaattgaccccgagatcccagcttagccaacagccctgggcaatttcatcagcttcctatatctcggtgtagccacgagcaagatcattttgtggcactgaactcacggtctgcaactcatgtgcattcaggacagacattgaggcttagggtcaggctgtaggtggcaccagccatcatgggacattcagaccagagaatgcagcaaccaagagcttgcttaggtaggcaagcaggagcgtttgtccactccatagccagccttcatctatcaggggacttgaaatgttcattgcacattcccctgtaggcaagagtatttattgagaagacctgaattttaatgcaaagctttccaaatggttgtttgtagccagttgacctttgagtccagacatcaggtggctccattcctctccagggccatggagcttcactgtgaccttgggggactgtccagccctctccatagtgttgagggagcagctccagctcttctcccctcactcttcctggcctccctggggccagtatcccattgttaacaccagcaccagtcccatgcctatgatttcttcttttttttttttttttcttttgagacagtctcactctgtcacccaggctgaagtgcagtggagctatcttggctcattgcgacctccacctcctgggttcaaggaattctgcctcagcctcccgagtagctggaatcacaagcatgcactaccatgcccggctaatttttgtatgtttagtagagacaggggttcaccatgttggccagactggtcctaaactcctgacctcaagtgacccacccacctcggccttaaactgctgggattacaggtgtgagccaccgtgcctggcctatgcctgtgattgctttacttcagaaaagaaagcatgcagtgtctgacttctgagcaaagctgtggctcccaacaggaagacatcttacaaacgcaggagagatgcaagctcacttagaaggggaaacgtgcttagttaatgccagggttcacatgtgaccatgtttaaaatgaccacagagggaaggagaacaaaaaagcaaactttgctgacactcaaatgttttctgtttctaagtggatgaccctgcctttctagatacaacgggtttcattcttcatgctgggcaggttgccggggtttggacaaatcctgctcagtgcaaagcatctcccaaggtaacagtccctgctggctgctttaggtaaatgtcagcttgttatgctgctggacagatcccacgtgggccctgttctctgtcattgccatctattctccaagaattctgtctcaatgagaagaaaaacagatcaacaggggagctgaggaatagatgggagctgcgagctgcagagggccaggactcggtgtgttccccacagcggccatctgcttggcttgtggagacgaccagctcggccacacttctgagattaggactccctgatgggccagcagaaggggctcttgtcaaatcccactttccctgattaaaccggaacaggaatgtctggcagagtagaaaatccagggaggagaggtgaggcctgcatcctggagggaaggttgtcctgagatgttcctgccatttttgtccccaaaagcgggatgatactagaggcgatggggcaggatccatcctgaatgtgtccggagagttttggaagatttgaccatcactgcaatagtctttcttctacagaaaataagtccggtaaaaatggggcaaaagttactcccacccagaggaatgagacatatgtgtccccctaccgaggggtgccccagagagtgggcacctagaagatctggttgttccccgcagtcacatacctccctgaattgaagtccttagagccacagaaaacttcctctggttttcttactagttactgttggagagagggtcattcctgattcctcctccagtgcagcctggcaggggagcctgctgagctctgctgtgtgaactttctgcccagagacaaggacagggatgagaggaggcagcaggtgagcagaagacaagacactggaagataagacctgtgcatcaggaccgagggaatatatgtgggagagacagagtccactgagatgcctcagctacccagggttcccactgtaaggaagccaccagtgtccagaggactccaggaaaaactcggatcccactttctgctactgaccagctgtgtgacctcagaccaggagtgcaatctctctgcacatctgacatctgtgtcaattcttccttaggagaggagagacgatttatgccttacccacttcttaaggcagtgttgaacaatgtcatcatgtgtaaaagcattttttaaaataagctgttgtctgcatggaggccatgattcatataaagcaatttgatttatacaatgaatctctccaagttttgctccttgcaaggttctgtgtcaataaatgttcaaacccatatttattgagcacctactataaataatcaggcgctgttttaagcacttctgatatgctggtaaaaaaaaacagatgcaaatacctgcctttgttacgctgacattctagaggacatttaaagagatctagttccatgtggatagagcaaaatgaaagggaaagttatactttagcacaaatgtcaatttcagaatggtttatttttaaaatgccagactctgccatcctgagattgactaactattgtctcaccatctctttgtcctggttaagttcagagaatacaatgtgcccagagtgcagccctgtttgaaaaggacggcttgcagagttgcagcaaaagtcatttctgggcagacgataatactaaacggaagctgatgaaagaaagagaaaaaaataccatgagagaagggggatgctggtgaaggtaaaatgttagtggagaggtagatttcaaatagaatcgcctaggttgaaaataaaaagcagtcatcaactatgatggaaaaatatttccgagacttgataagtcatccggaccctggctgctcactcccagggttgcgtgggatcctttgcaggatgagcagaggctgtcagtgtgggatgcgtaacacagcaggcacagggtaactgatctaattatgaagagcccttcccatctgatcctgactttgacctatggcttgtgaggccccagcaacattgaatccagggtgaaagtcagaaggactaggacccactcagctagttcaatcctctcatgccttcagtggctggagatatttagggagcacatcctatatgctaagccctaaataaggtgtcaggaatatagcagtgaactaggatggcaggtcccttccccaatgaaacccagtgtgggacaaaatgtgatcctggaaggtgagggtgattctgcaactcataaataaactgcgtgtgccagtagcaggccttgtggtaacacctaggcaggaccaccttctctgcacaacttcagagagcataacttaatttttacacattgaattttgatgtatttatttgtcattgcctaacatcccaaccccagcgtctgatggggatggcagtcctggcgttatgccatgggtagggtactgaggctagattccctgaatcctgaccgagtctcatcccatgagccagggtgatgaggctaatcaaacaaggaaccaaggagcccataggttgaaatacaaggtttggaagaaaatgtgatgcttgctggaatgaccagatgggcgaggatgttgaaaaataaatgaggtgtgatcattgcaattcattcccatcattacgaaatcatttattattaagttacacatggacacactgcagtgccaaggaaaagtacaaatgaaaggtaaaaacaagggacaaatgttgctcatgttgccagtaccttgttttgagtctggaagagaattatttatgttgctgcagccaaacgtctctaaagaaaatgatcaaattgtaattggtcaacatgttctctcaatgataccttgatacatcattttaattttaagtttttattcatctctaatgttttacttcaggcacttcttatttctttcttggaccattccaaaaatgtcctaaactggtatctcggccccagtccatcttctacgctctgaaaaaatacctttggttttatttttgcagagtcgattttttcccttcgtggatgggctccttggcaatctgagccttcgccctgctccctgccacccccctgccttgcactccaggcatgcacattcatgaaaattcctcaaaatcttagggaggctgaggcaggagaatcccttggacccgggaggtggaggttgcagtgagccgagattgcaccattgaacgcactgtagcctgtgtgacaagagcaaaactctgtctccaaaaaaaaaaaaaaaattccctcttgctcatgactcatttgtatgtgatgttccacttggcagccattttcctctagtccactggcccctggtgttcccgcggggcttcttacatgagccattctagaatcgcaggtcccttgctcttcctctgcacatgcctgtgtttatctggagagagtctgtttgtttccctgtttgccttcttaccagacttggagcccttcaaagccaagggctgtcccatatggatagaccttccccagtgtctaaataggaactgggatatgatagatgttcaataaaaattaaacaagagacaaaacaaaagtagggaccaatctggaatccagtaaccatctctcatttcaggagaagtggaaactctcaggaagttgaaaatactgggcttcagaacctgacctagtttgcagccaccgctcccctccaaaaacaatcccataagaattccttctgacccctgagatgagagggtcactgaggtggatcctggccttggaaatccctgttaggacctattgggaccttttacttgcccatcaccaccaccctaacattacattagaaaccaacttgggcttgaaatggaggcctctgagtttgcatgaaccccaaaatgcaggctcagattggtttcattgcaaaaagggaagttgcattccagttatctctgaataaaacttgtgatggtaaggacacagcccctacccctagaagtgaaaactggcaagtctccaggaaccaagaccactccaaggtccagttcttgcatcagcgaggccttgcttccttcttgcttcttaacaactggattccatgctcactcacggcttctcctctctctacctctggaatgtgcattgctgtcagagctgctttgtaatggctgcgtcctcatagcctagactctctctcctgagctttgaagcttcagtctgccctgctagccactaacagactcctgaatttctaagttcaggttcctacaatggaaaataagattgacctgactcatttcttcatgtggaatttttggctacagattggctgttgtttggtcaggccacaaaccccggtccaattgaccatgttttaccatattctcatcttgtccttagaaggttgcacagaggtgagttactgaccagaatgaacctaggcatggacatttaggaatttcctattaaacataaacacttcagagaagaaaagcatattccatcttaatacctcagaataaaggagcgtatcagcttcattccttttcagaggtacagcaggaatctatacacatcagggggccagttaatctgaaggatgagggggacgtctgaaagcagatgaggagaggaaaggaagaaggtagccctgaacctctgaactatgttcctggatctcgtcaatttagtccttactctctgtcaagttgatccattgacagattctcaaaaccaggtcaatatagagatatggcactcttacgtcttgtgtcagctgtatctgttatcaatagttttatgaatggcaccaccgacaaaggataaaaacctaactgcgattaggcaaggaaaatatatatataccagattttctggtcccccacaagtttcaccctagtgactgttctctgtcatcccacgcagggtgggctttgagaactcatcaatcctcttgtgagtttcagtcttgcatcttttctgggatctggctcaaacgtggctaatttcccagcatactatgttcagtacaagggcaatctgtcagcattcgtctgagcatgtttgtaaagacacataattcactatgaaaccaattcatttcagatgtgctttttcccattgcaccaaagccccgggttgatttggcagtttggtatattatacaaataaatatgtcgaaaatgggaagttaacaactgttggaacctgaggtttctgaaggacttggctctggtgtcaacttcagaaggtcatctggagaagctaagggatctgaacattcttaaaaggaagagaaatgctttagaataaaaggaatcctgtgtccacaggcaggcagagtctcgtttttgatttcctagggaacttagcacagtggagttccaatagctcataggaaatcgcgtttcacaaaagttacacaaaacaatacctttctgaggagtttatgttctaataggaaatacctaaaatatatttatccactttttaaattttattctaccttctctcttttaacactgatttacataataagggacagattaaattaatttcataatagaaatcttgggctttaaaaattatcttagaaaggtaattgtcttcatttggtgttttatgttccctaagtagttatctttgctgtttcttgtgggggttgctggcaattctgacttcccattccatatctcatttattacttcatttaggaaatactctttttttaatttgataggctgaggtctatttcctaatgactttcacctagttttaattttcagcaaaagaaacacttaagatataagtcataggtaatacttaggcctgtctgatgaatgacggaatctagcttccgctggtatttcatctttgacttctaacatgtaagaagccttcactttagtggtcatctctcctcctttttcgtccttgctcctttcagaagtgttcatctgtagcgtaggattcagtgatccccaagtgttttaagctgcagagctctttgttccgatgcttgtaattcacataaaggagataaaagtggagctgtgtgggctgaaggatgagaaggggagaggggggaaatggagccccaagttctagacaagcctccccccatcaactccttcatcctggcagcctaggaaaggttactctagcacaatttggaaacatctggctgagtcattttggcccacattttctttctgctgaattcatttgcattctcccagggcgacatacataaatgttttctagttcatgttgacatctttcagttattcatgaactgtgaccctactaccctgtgaggttctatgagaagctctgtgtgttgcaattctgtctgcattgctttgcagatgatgagttgcctaaaatgaatgaactggttctgacctatctaagtgtatcacatggagatgctcttgtctcttgatttcagtctaggtgacactcaggttttccaaaagttctctccctgatacacacattatttcattgtttcctgtgtgctaagcgcacacaggatgcaaagatgaataagaccttcccttacggagccctcagcctagccatgacgagagccagttatggagtccctactagatgtccattgctttacatagtttctatctcattaactttggtgcacatagccagtaagcgaaaggacccgggatttgcaaacaagaaattattctgacttcaacgctcattcctttcactgatgggcaaccctttatcttacctggtccctgccacggagaaactcacaggcagggccgggcagagaagtggtcagtgatgctctaaggtaacaagcacttcccataagcctggggtaggaggtgacatttgcacggggcactaaaggatgattaggagctcatcaggtggaaggagttgggagtggggctggagctggtgtctttgctaatgccttctaggggaagatgccaagtgttttagatttccattgcttatacttatctccagtttttagtggcctacttgaatgtcatttatattgtcatttacaccactccccaaggccaaatcatatctgtgttgcaaagttggccaacagggattgtatgaactgagccttctctggagattttctgcatgggtctgttagttcatgtatttcatgttgagaataaagtatgggcacgtgaaggtttgggggatattttacataagacattctcctatgtaggcatgaaaatctttcctgactccaatcctgttgctaaacagcgaggtctagcccagaaggcatggaggggagcagagtttctgggaaacaagaagaggacttggagccccagacaggggacaactccagagggtttcttggggatacctttccctacaggccactgaagacagcacggcagtggaaacatctgcatcacccaccctggtgtgtgttcccccgacaatctgtgggcttgttccacagctggcaccaaattctggctgagcagacagccccagaaatgtcacctggagccgttaaaaaaacataaacaaggcatctgtcacgctgccgtcgccaaggtcatctggtggcaggaggtgaccgaggaggagcatggtggtgccgtgccatcgagggccaacctgtgggcagacctgcctgtgccggcgctcccttgctctgcagatgcattcaaggatgtgaagttgtgcaggggccagacgtgagaagcaaaacaacctgaatgaaatccagccactttggagtgaaacatgagcattttaaaacatgattttcaaactgtcgcagggttagtattgcatctggtctcctctcatgattgcctggaggccaccagcccaaagctggagtgagacatgagctggagggtaacctgaacaccgaatttagggagtgtgttgttcatacaaatcactcagactgagagttagagatgggatttacacccaagctatccatcaaaccactatctgtgtgaccttcgacaacttatccatttcctctaagccccaattttcatatctgtaaattccctcctaggatccttgtgaaggttagataagatagtatgtgtaataatgcagggctgcagagggccctcagtacattttattttggctttctctgccctcacttacaggtgagggaacagatttagagacggggagttcatagcataccagcatcaatgatcctagcaagaactgtcgtactttcttcctccttccttcacttcctttttccttatttccctcataatccactccccttcccctccctaccctcagtgcacatgatattatgtttgatgggtagcttttggtttgtatataattttggcaaaacacattctttgtagaaatgtattctttaatttgttaaatggtttgagtttatacatggatgccttatgtgttttgtgcgtatttacatttatatttagattcctcttttttcttaagtactgtgtctatgttccctccctgttgctctgtgtacacataatcgattgcttattgctctgtgtatgcataaacagttgcttcttttttttttttttttttgagacagagtctctctctgtcacccaggctggagtgcagtggtgctatctcggctcactgcaagctctacctcccaggttcacgccattctcctgcctcagcctcccgagcagctgagactacaggcacctgccaccatgctggctaattttttgtattttttagtaaagacggggtttcaccatgttagccaggatggtctcaatctcgtgaccttgtgatccgcctgcctcggcctcgcaaagtgctgggatgacaggcgtgagccaccgcgcccggctgccgttgcttctaattgctgcttagccttgcatggttgcatccagtctgttccacaaggatggacacccaggttgcctccacactatccccatagtccatcttcttgtaattcttaagataggaccaaaagacatttatttacaagtttccctcttctattagacggtgagacagtgagagaagatttcctgactttatatacaaagcagctagcacatagcagtttctcagtaaacacaaagccattggcttcccaggcagctggacacatgggctcaggcccagcctcctgtgtccttggttcccaggaaaagtgacagccttaacggcagcactgtgattaccgttatcttgtcatgaaggtttatgacgagtaagggaagtgccttttaggaagagaaaagatgaaaagccttcccatgtgacgtatactagaattccctgaaacctgaaggccccacatgatgcacctgtttattcaaacacatacatttgagtactaactgtaagtgatagtgggtatggatttggtgaactctttgaatgctttcagcatttccccaatctgtaggagattctagttccttagaattggatactgagccctgtttgatgaaacttgctgtggcatttggagaggatgcagctagggttcacacatttaaccatggatggatctgtcagtcagtctcagttcatggtagacaagaaaggagatacatgctgacaagccgtgtaggaagtgtactgccttaagcagtgtaaacatctttattcctgaaaggcatatctgctaggttgattgtgaaatgtattctgtttttttttttttgttttgtttttctatttggagggtgagggatagcctactttaatatcagaagattttttttttattgaattgtggtactgagtgaaatgacctacctttacttgacctgcaacagagttgctgtagaccaggggtgggcaaattctttctgcaagaaccaggtaataagtattttacactttacggctacatggcctttgtcaaacctgtcacctctcctgttgtggtacataggcagccattagacagtctataagtaaatgggcttagctgcattccaataaaactttattcacaaaataagaagggggccaggtttggcccatgagccctggttttcctacccttgtttagatgctcatgcacttgctacacctggaaatcaacataaatatagtaggtccaataaggcaaaccagctactgtttcttgccagtattctctgctctctcttcaggacactctgaacacaatggataggagtaatatgaacagaaaacagaagaaggacttggactgtatcaattttggcttggttgtgcacgccagaaaacctaaaataacagtgcccagtacacagcagaagtttatttctctttcttgtaaatacagtttggagacaagcagtccagggatagcatggctcctcttctcacaaaagcctctgctccttctattatgttttctcccacgaagggtttggtctcatggttccagattgtagcaagcattccagataggcagatgggaaaaggcgggaaggagagggagagtaaatgaagagcgtgcacgctgacagatgctgcgacgagcttttccagttgctgcctgtcatggttagttttaggtgtcagcttggctaggccacggtacccagcttcttctcaaacaccaggcgacatgttgctgtggagttttgttttgaagatgtgattgataattcagttagcggacatggagtagagcaggtccccctctaccatgtgggtgggcctcgtccgattagttgaaggctttaggagaaaataatgaggtctcccagggaggaaaggattctgcctccagacagccttcaggcttgagccaccatcccaactcttccccgggtttccagccagctgccctgccctgcagacttcacatctgccagcccccacaatccaccatccttaaaaatctgtctctctctctccacacacacacatacacacactattggttgtgcatctctggagacccctgctgcgtgtgcagcctattcatctagaaggctccggggcagtgggggatctactccttatccacagcattctaatattctggagacacaagagaagggacatggaagggcaggcagacattaaactacccagaagcgatgtgtgcctgtgctcttattgcacctccacattcttatttttcttactaataaagaatttaaaatgaaggaagccccagatcacccgggtgtgattctctagccttttcccacttctagttcaagagatgtacccgtgttcttttaaccaaagaaaaaatcattgcatcctttactctagcagtagtgcctgaagcatggggtgaaggtgatgagtgcgttagggcctttgggaactctgtcccagccaaccctcaccgtccataccctgctgggagggaaagctgtggccccggcagctctcttggtttatactcccaagaggaaactcttcctctcgaagcctgggggagggacagactttggaccaagttcactctcccagctataatttgaagtgtggacaaaatgggcccagatgttcagccttgcttgttgggcctggctctggtctgcgttctcatccgcgagaccctcggcctccctgcccacaccaactcgccttgggtcttctttgagacattcttactgaacaagaaataattccccagggttagattactggacacaggagaaatgtgttctgcaagctgaggagaattgaatttggcttcagggacttcctcctccccaggtgaggtttaccagtctgtaaggatctcacaggtgatttgggtccatttttggtgcactttatttctcttcctagaccctttcctctgtcttcccagacccttcccctcaaaggggtgctggcgttgggttgcccacggctccttgccccggtgagccctgaccacgcagacccagcagcttccagggacctcagcatttaagtaatgggcgtgcaagagaaaaccaaaaccaaacccaaacaagcctccaaatgcagggagaactcctcagtgggagctggagagttctagttgaaatgtctgaggtgacagtgagcacgcagtggtcgactgtcggaaagctggtcctcaggccagaaaactcatccacagttccatcccaacttggtctttttgtatgagttgaagaaaaagtgtgggttttttgttgttgttgtttctttctttccaactagtttctttggatcctggcatgactccagaagaatcgtaccctgctgccccacattcatttttatttttaggggattgtaagttagaagaagtgacttctcttgcagatggcaaagacttacaatccaaaatcatcacaactcacaatttaaagacattttgatctctaccttcctgagcaaatcagccggcaggcctatttcttgtagggctttcgtctgcacatagtaggtcctggataaacacttgctgattaaatgatattcgaagcaaagcgactgcagctgattgtctacttagggcaaggtgagtgtaaatcagaagggtgagaaattgcatcaggctgcggagggatgcaggcttgcacggctacaaacaaacctaattagctgtgcctctgccagcagccctactcagacacatctggaggggggagaatggctaaggctagattggctttcccaagtgaaaacgcctctcttcagttgcacctgcacaggactgattgcgcctcaaatccatttgtcaggctggttgcaggtatctgagaaattgctaatagaattgggcaaaagtgcccgtgggagtgggaggtaaatagcatggcaagacaagcggctgctggagtcccgggttggcaggtgggcctgcccccatgccccgccaggctccagggggtacctatgcccagtgactacagagaagacccgtcttggctgagcatcaggctctggtgcagtctttgctaagtgtgtttatcggccaccacgagagtacttagctgcaaaatggaggtgctttcactcacagacaccaggagccttcactagggaggcactgagatcagcactttttccaagatgctccttgcaaggtacttgtgctccatcaaattgcaattcttcctagacacaaagggaggcactggcccagagtcaaggtcatagcaagaccccttgagctgcctgtttcttagcagaagctggagtagacagacatgacttgagacgtcttaaacttgtttggagaatttgggactggatctcccgcccaagcactttggaggggtctgaagagacacaggacgtgtgtatacgtgtgtggggatttggggctgtgtgtgtgtggggttggggcaagggcttggatcaaacatctggatatgaataccaactctgctgttttctgctgactgtgaacttggaagagtttcttatcagttcaagcctcacttccctcataaatgaaatggggatagtaatcattattatgggctgttgggtcccccaaaaatccatgtgttgaagtcttaacacccagtgcttcagaatgtgatgatatttggagatacggtctttaaagaggtgaatcaagttaaaatgaggtcctatgggtgggccctaatttaatatggctgatgtccttataagaagagagattaggacacagacacacacaggcgatgttatatggtggtttagggtctagactgccaaggttcaagttctgctgtgacttacttgctctgagtgaccttgggtttcatattaaattttctgaatatcaatttcctcacctgtaaaatgggggaaataacagtctgcctcatggtgttgctggaggtgtgaggtcagatattaaccatctggcacttccaccgctgcaggtagcttggccattgttattgttatgattaagggcaggtgagcatgtagtgtctttctttgctaagtatgtctgatgccaagtcagtattcattgagcacctcttctgtgcaaggcgcttggaaaggagtgcagtggctctttttccccactcttgcccctgctagattcatcctcaagtcttctctgagttgcttttcctgcagcccgtagttactgaaaaccataatacttatagatgctgctttctagaaatgagcctgtaaagtcttgtattttctcttggtctgcacaactttagggggggtaacacgtcctgtatttgccagttgttaaccttctctttgaccacggagctctagatgatggcaccgataatgcccaggcagatttagttttgatctccaatgaaagataggcctttctgtatttgcagtaataagcaaacacctttagcttgagaggataaacttaagtacaatgtttgttctctggaggcatactgattaactttaaaatatgaataaaaggcagtcctatttcattatggtaagaacacttaatacaagatctgccctctttttttttttttttttttttttttttgttggagacagagctctcacccgggctgtcacccagctctgtcacccaggctggagtgcagtggtgcaatctcggctcactgcaacctccacctcccaggttcaagtgatcctcctgcctcagcctcccgagcagctaggactacaggagcgtgacaccacgcccggctaattttttgcatttttagcagagacggggtttcaccatgttagccaggatggtctcgatctcctgacctcgtgatctaccctcttaacggatttttagtgtgcaagttatctgtaggtacaaggttgtacagcagatctgtcaaacttattcatctcacataattgagactttatgcctttcaattagcaactcctcacctcccgctcccaccagtcccaggcaaccactaccctgttccttttgcctccgtgagtttggctactttcaaagcctcatagaagtggaactgtgccgcatttgttcttctgtgcctggctcatttctcttggcatctttcctccaggttcattcatgctgtcaccaatggcaggatatctcgctcttttgtttttaaaaacagccaaagtcaagtatgtaaaaaggtgggcagctgagaacctggtaccagaatgttccaaggaaaggtactgagtggcacaacctggcctggttctccaccagtaattcctaaacttccccacctggaggctcctgatgacagatgggtgaatggcagagtagatgagtgagggaggtggggagccccggtggggcctggctggtcaaagtccaagcaatctgatcccagcaggacattcctttgaaggatcatgtatcactttacaaatatccacaagctttgcactctatccatatttgtttaggtgtaaaaaaatattttaagctctttactgagaaggaaaatgggatgcacccacatggattccccagcatgcaccgctgagcattccctgtggtaccgctcctcagtttagggtttaggtcaggggccctggaatcattgaaggagacctgtcttcctctcgtctgctgtcttcctcctggatatcacccctgggtcaagcccatggtctcagtgggttagcaatgaatccttcctaagatgcgaacagatgggagctcaacatttgacccatccctggggttttagtttttttgtttgtttgtttgttttgagacggagtcttgccctgtcacccaggctggagtgcaatggcaccatctcagctcactgcaacttccgcccctcaggttcaagcgattctcctgccttagcctctcaagtagctgggattacaggcatgcgccgccacgcccagctaattggggttttaggtttaagaggaatcccagaaggacagggtgatctgaggtcctgagcaactctgaggctgaaactgcgctggtctactttaaggcaggggctgtgattttccctgtgactgaggtcctccaggggtcaactgcatttcaggtgtgtgaggggagagtgactgcccacctggctacccagcccttctttctgagcctgtttactcagctgctggggcctccatgacaggtttgcttggtgaccttacaccgcagtggctcccagggccagagacgtgaccaaggagggaccttgcactgaggaacctgtgaccgtaggaagaccctctaaggccgactcttgcttggcccggcccagtccctcctaccaacactgataagaacttaggttcctagcatcccaggaggcagggtcacaaagacaagctgagaactgataccactgctatacccacccctggacctccctgtcccatgcaggagtctaagccagtgcaaccaaggccaagcacacacccataccacacagcaagggtttcacacggggttttcatttctttacccctggccgaaccatgcaagctaccagccatctacccagacttcttagagtctgccaaatacgtactcagaccagaattaagttcaggccatggtagaggtgaccagccactctgccgtgacctggattcagccatcaattccaaagaagcccacagtgccttgcattttgctggctggtttgtttttgtaaaatgatggggtgggaagcagtgctgggcattggaaaggggctgaacaaggggaaatcttcaacaccttttaaatggaagcatgtctagttggcctcttttctgtaaggaactatactgggcatcacagagatgcaaagactagagtgactgattcaggccctggcctgaaggactttattattgagagttccccgtatatataaatggctgaactctcaggccagtgaatgcctgtgaccaagtgccaatgggtgaaagtagaggttccagaccaggagtgggaaatgcatcaacagagagcttggccacatgctggcctggagtgcagagaaagagtgccaggcctctgggcactgagttctgagctgcttctggagggccaggagatactcccacctgcaaatgactggctgattgcactttccttagagtttgccacctgcatttccgctctacccactaactgactgctccggtgcagggagccaggcaggggcagtggtacctgggtcaggacacgacagcagcctctggcctcaggcagggagtgctggacagtccgtctcctgtcctgctttgtctctttctccttgagctcaggacacagtggggagccctcatgtttctgtaaggtcatcacacaggctggaatgttttttttttcctctctctctctccctgtctttcttttaatggacaaacacccttgaggtcctggttgattttcttagagaaatgtagattctttgattctaacgatggaacataagttttctgaattttgaggaaaacaaagcccaagatttcaacaaccagtgttcctgccaaatccactgggcaaacagaaaagctgcctgcctccggtgctcccagacccccttccttctcaaacacgcatcagacactttgcaccaagaaaaaacaaagggcatccctcctggggccacctctgccccctgtccaggtacgcgctgtctggcgcgccctgcgtgggggccgcaggttcagacacccgggcgcggcgcggggccctgatggatgcggtgaccgaggctgtggctgcgggcgcggcgtctccgcggcagtcgctgcctccgcggccccctccccagccccagccccagccccagccccagccccagccccagccccagccccagccccagccccagcccggctgagcgggcggccggagcatgcgccgtgggcgccgggccgggaggcgggcgaggaggcagcgcgcatcactcgggtccccttcctgcacccagccgccacttgccggttgctaagcagttatcattgtttctgtggcgattgcagaggctgttgctaattggagaagccccactaagcagcggcagcttcctgcttcggatcctctctctgctgcttgcatttaaagagcaaactcgtcttgtctacccaccctccctcccccatcctccccaaaatagccttgtgatttcggaagtatggactaaaatcacactcctccttaccttaccgcttggactctggtggctcccaactcgccgtcagaccccacctgccccggtggtgggaagcgcctggacagaccatgaccacagccaaggagccaagcgcttcggggaaatccgtgcagcagcaggaacaggtaatgctgcttttgggggtccgtgtgtgtgtgtgtgcgtgcgtgtgcatgcgtgcatatgtgtgtgcatgagagagacagagacagagagggaggatatgtatttggggaagaattttgtattttgtattggtttatgactgtagccccctgagccaccaagctgggaggagacgtagagtgctgggtgctgctggagtctgcggctctcctctccctggcttctctctctaaagggcgccctggcttgatgattaaggtacaggcacagggaacctctgtcaaggtaaacttgatgtgaaacacctctggacaaaggcctctctctacagagccgccagatctaacgagttccctgggaaggttcccagctagtactttgtaacttgggggaagagggttgtagccagaaacatcagcgtattctgaccctccaacaggactttgctttggttctaagacaagtcaaagaaaatgagcttactgaaaggacttttctttggatacctcgtggccctttcctcctgtttccctcaagagcaaactgtccctgctagagaagccgaaggatagacggtcgggataaaggaggactcggccgagaaggtgcaggtttaaagggctgaccgcggacggggaaggctgcgtgggtcccacatggcacagggcggccgctcgccttgtcctgagaagaccacggtctgcagaggcccaaggggtgagggaggaaaggtgagtcagccagccgcttcaccacgcgtgtagacatcgtaattccctccttggaagatcttgagggttcttgtcttttaatcattgctcagttcacctcaggcagatcattaaaatagatcctgggagacaccaatagattcacaaagcagtttgctcaagcgtggtaaatcaacagcttaagctgacttctcctatttattttagggttgctgttggatctcatttgctaggattagggcaaagataggcgacctctttagagttcaggaagctgaagagcctccttgaggacactgtgtgacagaattccatgccaactcttcagagacttacacgaagatgagtttggatttgtatttagtggggtcatttcccaaagcccatttatcgataaaagggggccattttattagtaccatcattatcatcatctaaagaacttaaatgaagttttatgtcatctgggaagaagattctgtaaatacggacattaaaaatttttatattcagtgtgacagtgtgcataaggattgatgctcagtatagcttgacaggttcaaaacagacaaaccaaaccctcctcctttcaaaaattccacagaatatttgctcaataaagaaatatttccacactaaattagcattctgtaattaactgggtttctttttattacagttctcctccctcattagttatgaagtaagtgtgcgatgggctttcaggcttgaactaggactcaggtagcatccctgaccatgggagagaagtaataattacgaaagagtgcattgctgttcataggtctacacccgatacacccaaggattgggagtcagaagcccaatctgtgttatgtaaaagaaatcccttgtttcctgtacaaatttgctcttattttgcctgatacctgagcatgccaggagagtgggaatagttaattagggtgtgggttttggaggacctatgagctcttggtttgattttatacctttttgtcattggaaatcccatgtccttgaacctattcaatcggagaaggcttaaactgatataaaactgaagagcagaggcagccatggctacagcgagcaggtgggacacccagaagaagcagctgtcctcatcccatgcagttgtgaagccgctttttctccctcctcagagaggtgtcacctcaaccctaaaaaatgaacagcccccacccccaccatgaagtataatgaagaggggaacagcagagataagataagccagatgggacagggggtgaagaccccacatttcaagtgtatataccttgaggagaccttacctggggtctgaacacactgcttagaacataaagaggtaaataacctcctaaaataaaatccctaaagacagtctcttattcctgcattatatataattttgaaaggtattaaaactatgctgtgtgcttagactgcagaactcttaatgagttctccattctttattttattttattttcctggttgctaatgaaacttcagggatacctctattcccaggctggtaggcatgtgtagggagaccaggaaagaggaatatgtttctttttttttttttttaatttattttttgagtgagagagaggattgctgctttgtggattggttttgaagcagggggtcattaaactgtgctaactcaatgactgcctgcaaatcaccaagtgttgattcttatgagaaactcactggcacctcacatcctcatcttgtgaggcattaaccagagaactgggattgaatggagcctgatgccatctccgacatccttccagctgtttggttactgcaatagactacccattacttcttagcaagtgaacagaggaaagtgagtttctttaccagccttggtatttggaaaccaggcatatgggtggtgggtggaaataatttttgtgtgctgaggatggccacaaattaggggggaaattagaaaaaaaaaagattttactattagttagagattgttgttttttttctaccgtgtttgctaaaaaaaatgtgtaaaaagagtattttgggatttttggtttgttttttaaaggatactaaataaacaagccagagtaacaaggagaattggcttctgggagactatttctctttctctttggagatgctaaagtttatttttaaatgaagtattgcaaacccagagatgtttggaagcaatatatactttaatctgcatgaactgagttgatcctttggctctgaagccaatcaggtgatactgagactcctcggtgaaaatggctgagcattggctgcacctgacctctgctcctgcgcagagggaagcctggtgagggacccagaaaaaacactgaggcaagtctggcttaaatttactatattctcacaagccaacggagctcttccttagaaaaccaaattaagggattttttttcccttaaaataaataaaagtacaaatttattgtagtacatactgtctccatttcaaatgatttaaaattgaaaagcagtgatcagtaaagctattaagagaagacgaaaaattaattccctctgcttgcaatgagccaggacacatttttgctcaaatattaagcagggataagtttttcctagcatattgtgtgcatgtgtatgtatgtgtgtgcatgcgtatgcacacacaaacaaatgcacacacgtgaacagtcacacacaggcacacctcgtgtgtcacaaaatcagagttggaaaggaccccacacatgcactcgttggtcctagttcatgctctcgtgctgaggaatctcacaaatgtgtgagaatatgcctttcctcaaaagatctccagaaaaacctcctttcacatggaaatagcctacattccactggctaacttggatctttggttatatgttcagtcacatttttaacttccttagacctgaaaatcagctgttctcatcacaccttgtatatgtgactgctgttttttgttgcttctcagttttcttcaagttgtacaaatcctgatagataactccccatgtgtctgttcttctattaaattatgagccccaggacctagtattaacttaaatttggtgtctgaacatatataataatgccattacagaagaactttttgaaatgaatagaaatttttaaacaacagattccatagaacggacattgaaatgcatgtgaattctgggagaggttaggtggcctcccggaagggcacataggtaatggcccagtaagagaatttctgatgttcctgtccgctgctctctgattttgatcttgttgcttcttgcagtagatactgaaagagaggatctaactttgaccataatgagagttaaattttttatgtagccatattaaaaggcaatgtgagacatccgtatttaagataaatgtggtaacaggaaaaaaaagaagtgaaaagaacacagaaaaacaagattcaatattaggaagtgcacataactattgaggagtcccaatagggaaggtggtccttttgcagttcaaaaagggcatggggtggggttggtggccctttcacagttcacacggacattggatgtagcagccatgctcacgtacagtaaattccatctgtgcatggtctaaattatctaagactctgtagataaaaagaaaacttgaaggaactgctgaagaatagggacaccaggttcttaggattgtgtagaagtacatctgggactcatggacttccagagccgggagacaggatggagtttggctgcaaaataggctgatgtgtgaaggatttgaggagagaactgggaagtcttggatatcctacagagagcaggtccagaaccagagctccctactgggaacaccagagtgggtccttgagctgatggggagcagcatggagtctttggggaagggaaagagcttagctggtgtggtgctatcctcagaggagggatgttttgcttgttaccaaagagaacaacatgatgaggaagcaagcacgcaactagcctggaggcggcatgcgctgtgctctgagaactgacaggtagttcacaatcttttgggatccgtgtcaccaacttactaaaaagtgcaaatcagcaagtgccatttagcacatcaaatgaaagcccaggcaattgagagcaaggacaaatgatacccagattggcttttggtgcaacccaaactcaaaacaatggaaacagtgtttctgtttggttttgttttttaaaatgctttctctgtgcattaaatgcattttgttattttattctgacattccattaaaccaaatccagccccctcattctcaatactgtggttatcagggcagatatactcaaaaccttcaaatgctccatggagaacacgtgagggctggagggtgcttttcattaaccttcaccgaaacatcttagctccagcgtgcacgtggaaagtgttaagatgctaatcacttagaggaatgaacagcgtgcacgtggaaagtgttaagatgctaatcacttagaggaatgaacggtcaccgtctctgcctcatcgggaattgtagcgttattatcttttatggaaatgagctgtgcctgtgtttggcactcactgatctagttttgcagtaggcatcatgcaccctctgtcattgagaaagagagggcagagtgaatctgtggatccagagttctaaaacctgaggaagagtatataattcggggagaaagtgattctctataagctctgagaggtcaatggttgacatccttgcttgtaaaagatcggacaggtagggggtgtatcatcttgtttcagacactgtttggaaaaacaaaataaagtggttttatttgaagatgtaggcttggttaccccatagccttaaatcatggaagtaggtaaccatgtcaatttgcatggggagccgcgtgcagtggctcatacctgcagtctttgggaggccgacgagagaggattgcttgagtttaggagttcaacaccagcctgggcaacatggcgaagccccatgtctagaaaaaatagaaaaattatccaggcgtggtggtggcgcatgcctgttgtcccagttactcaggaggctgaggtaggaggatcacctgagcccagggaggtcaagtttgcagtgagccgtgatcacaccgctgaactctagcctgggcaatggagtgaaaccctgtctccacaaaaaaaaaaaagaaaaagaaaaagaaaatctgggtgggatgtaaattgcaatcctgtttgttggtgcaattctgcatgtggctgatatcctaaagtccttcctgactttgatagcatgtgtttcttgaagtggggagtggagaggtctcaacacacacagcccaggtagaatgatcaaatccagaaagtttattctctgtcctactcccatccccatttgttgttgacctttcaggactctttacttctacatcccgggtaggcccttaatctccactggtacccatggtttagcaccattttctcatacttgactcttctatcaaaaatgctccatgtgcttttccacctgggccttgctaaatgactgagacaaatccattcattaaacaaaaagtgtaaggtgggtgtcatgcagtactttcctgagagcatttgcaatttcaacagtagctattggtgataaaacccaatgcaattattaatggtggaaatttcaggcacaaagttgtggcaagacctgatggaagaaaaaatatttagtcacatcgttaaggaataatgaaggtgaggtcacagcggggacagtcttggcaccccttaaatcatcgacaggctgtgcacatcctggaggtatctgttcattctgtgttcacattagagctggtcttgtatcaggcaagtaccaaattacagatcctgttgctgctttctgctttcaaatcctgaaggatttgatagtaatagtgttgaaatgtgcagcgattccttcttaggaaaaactgccataatatgcacaggcatggagtcagtgctgtgggtcccctttgatcctggtggctgggatcctgaatgcagccctccaccaatggctttacaaagcacgttgctgatataatgaagtcttgctccgcaaatttttagtgacaatgtatgtaattattcctttactagtatctgatccatttttaagaaatttaacttcccctgccagaattcaagaaaaactgctttccccagtgtggaactgcacgagactcaagcgtcacctcgagctgctaagttattaatttggaacacaggcttttaaacaatatctgtatgtgcgcccatgtatgtgtgggcagagggggcgatgggagaccagccaaatctgctgattaaaatgggaacaccgtggtgatggcggggctctctcaaaacactttaaaaggccgaagtccatcttgtggacatgctcataagatttctcttggagacaatggtaattcattctcttaaaaaggattggttcaaccctttgagtaggctacccacagcaagatgtgagatcagaaccaaaaaatattcaaagcatattccatgttttgtcttttggaaataatatgtgacagaggtggtcttgaatagtaatgatatatgtttccaaattaatgaaaataagttatttctttattctctagcagtgattcttgaaattcttcattctttttagaatatttgaagttgttatagcattcactctaggaattccaaaattatgacactaagtatgtatctcaaatcaggcctctgagtgggaaagggaaggaaacatatttttaattttaatagtctgcctaatatcccatccacttattagacagatattggatccaaggaagatttttattttgataaacagtaatgggagagccaaggtagggggaaaggagagctggatgggaacagctcaaggtcaggagagagcagaacagtccacagccagggtgcctggacccaaggtgcagccagcggtctgctggagaaaggtggaatgtggctgcaggggcacacagagatggtttgggaaaacagaaacaggaactgtgatatgaaagtgttttgaaagcatacaatggaaaacagcaatgggcttgtaaagttctagaagggagggaggaagtctgaacgtggcacgagaggctcttgcttaagagaacaggtgtttgtggaataggtaaaaccagaggagtgacttggacatcaaaattttattttctgaatgtgattatttaatctaggcatgttttgataggtgaaaaaagggactagaaacttctggctttcaaagagcaaaaagagtttgttatttcacaaataaattcaagtttacctagaagcaacaagatattttaagatatggtatatatatatatatatatatatatatatacacacacacgcacgcacacacacacacacacacacacccttacatatatatgtagtacttcctggaatagcctgagaaagaaacatttaggaagactcaatataattattaatacaatttctggctctgattttgatgagccagatattttgatgttcattttgatgcagtctgccatgcctggaacaccaggtcatatggtacatatgacttggttaaagaagagattaaccaataagagaactttggcaggtaagaactattttgccattaaaaaccatgaagctgtaacaacgtctcaaaagctcccttggtgcattttattaattctttctgctcattactaggcttgggatgatgaagacctgacccttgacttgccaatagctaacttacgggggagttgggagaattgctgtgctttggcatggatgcccctgacttctgatccgagctcctccacctgctagctgagggatattggacagttctggactgattctgtatctatgaaatggggatgattcctgtcacgctgttgctgtaaaaaacaaaatatagaaacacggaatgctgttcttggcatggagatttcaaactattgttcagtgaacacctactatgtgctgacatcccaatgctacttgaatcttcttattttcagcatttggtcagagctcatgtcccatttttaagatgatttgttctacaaaatcatagaatgtttgacttttaaagcttcttatagcccctcttgcccagtgatttttggacttttgttttagtaacgtaaaccccttttccaaagggcacgtcttttccaagattggcatgtgaaggtggtgaacgtgctggcttagtgcccctgagacgtgtcagcagagccccagggcatgggggagcccagctcacaaaccacacatctaattcagcagtctaatcttgcacaggagtaaaaccaagctcagagaggttgagtaaattaccaaaatcatgcagctggcaagctgcaaattcagaacacaactccctccttttttttttcctccaaatcaagcaatcctgagtgaaacgtgggaaatataatatgccaagaagattaacacgaaaactgttaactggcagctgcaaaggaaataaaggaattagataatatgaatgggttaacaaattctcgcctggaggtcagttaagaaaaggtttgtgtcctccaggtaaatcaaacctactgcggtttttcctcttcacatctcatggacaaacacagccatttcttctttttattgcaccagtgctggatgcatgaggttgttcgtagcaatctgtcatatttgagtaattcgttatttaatgagttgcttttgaaacaaggaaaataatgaggatgttaccgttgtgtatctccccaatttttaaaaggaagcaacaaatagtaaattatgcatgctttggaagtatgcagtagttaattttcaatctcatcttacagctgaataacctcaaaggtagtagttatacaacaggtgtgggaatatgtgagtgtgagggagaggaatcccaggacatcacctgtacacattgggggtttggcccagcagggcttcagatgttgaaacatctggaaattttatttgctcacaagcttaaaatgaaccaaaagtatgttgcttattaacacttttgaggatctgatgaaagccataggactgcttgccagaaaaatccctacaattttttgagttcctaaggttcacattcccttcatttctgtctgtggactccaggttgagcgtctctgtggtcaccatggtccccagcaagctagcacagtcttaagacacatcagtaggaatgtactcagtgctcaaagcttacatagatattgaccagcagccatcacctctggggggctgtgctagggaggcacagcatgtagaagaggctggaatgggccagggagagtggtaagggagcaatgggtaggagatcccagaagtggtaggtaatggaccgtgatccatgtcaggtgattaaaggctaaaggaatatggttctgtcctcaaccacatggtggcctcagcctgggatacatgactgtgtcttcctccataggggtcagtttaactaagaaccccaagtattgaagacctcaagactttaatatggtacttcctgtaccttgacacacatatataagcttctgaaggacacaaaacatgccacgttacttgttgtatctctgacgccaagcacaatggtgacccacttgcttgtgtgctaaatgaatcagtgagtgaatgaattgtgtcctcctctctaaacctcctctactgagttatacacaaagttgagggtctgtggttttactatttattcatcgaatgaaccattgaacaaagtaatcaaattttcagagccctgtagagaaatcaaatctccctctgaattgctaactcaccttgctttccctattgtttaaagtgtcatagccactcttcctttcccaacactccaccctcacctgtcctacccaaaaacatttctctgctacagaagcatgaactattcactccagccaccagccatgcatcaacattcagtcttgctgtgattcatctccataagataagtgaatattctctcatttaccaactgtatagataagaaaaccatcagaaatcaaagaactgttgaaaaatgggcattttacatcaccaaagcccttttttgttgttgaaacagaagcttcaagtcttctccatccactgaaatgagttgttgaagtggaaaagtaagttctaattgaaccaccttctccgatgcagagaaaaagcagacttgaacaattgggttgatcttctatttctcaggttggagaagtgctttgaggaaagaaagatggggaatcaagatcagaggaatgcaaagttctggaatgtttgcctcagttgccctctactgggtctggcttggggaagtttgtagaactttttaatgagtcattgtaggttcaggagagatttcagatgtgggggacagggtgaaatgctttcttacacagaagtgaatgagttagtgaaactgtagcacgtacagtttgggagaatgggggcaatggggggattgtggtacgggagaaggagcaccagcctgggattcagacaggtctgagtttaaattccagctctggcacttgctaggtaggcagcgttggacaagttgggtaacctcagtttccaccttgagcaagtgcttgactaataacagctgtgactgttaccagtatggtaattacagtatcccaaggtgtaaagaagcagaagcatgattatatgagttgggtcaaagatttggctgtctccctgtccccccaccaatctggctacagggcagactttgctaaatagacacagatttacttccaatgaagtgggtttgctgcactgaataaagtagtttacttttccttcactgcagctgtgcttgaaattggacagaaagccaggtgtggtggctcacgcctgtaatcacagcactttgggaggctgaggcgggcggatcatgaggtcaggagattgagaccatcctggctaacatggtgaatccagcctgggcgacagagcatgactctgtctcaaaataaataaataataataaattggacagaaaataagatagagttgtagcaattagtctgcagtttttgactttattaaattcacttagacatgtggctgcaccattatgctaaggtacctgaggctctactatggtgtattcattgtcgaaaatgtgtttgcgatgtagatacttctttcacctagttctatagtgatactattgggaatctgaagttgtcaagcagctagtgtatataattgcatgtaaaatagactgtattttgtacttattgaaatctaatggtgatacttggttttagattactgaatgtagattctgaagaattatggccccagtaatgaatggatgtgtaattagaatttttatcattattctgtaacatctctgctgaaaatttcaggtttatataattgttttggcttggcttgaaacacaaattatacttaaagtaacagacagtaattgagaaaattatacttaaaggaacagacagtaattgaatccaataaaaacaccaaagaagatcaagattgctgtgagtggagagtctggcttgtatattttgcgaacctcatggcttgaatgacatattctcaacaaatgcatgccaagtaaagaaaatactgactttatgtttttgattcaaatattcatttcatgaaactccaaataacttttagtgatatggtagtttatgtgttgatccagtgttttaaattttaacaatatacagagaattcctaattacactggagattttgaaattttcaaaaaataaaattttgtataagctttaccctgtgagggaatcctcacttctggtctcaaatcagctagtgttgggcattgaaaatattcacagagattatgtattaattatatagttgtacttagaaatgtatatgagagttgttaatgacataggactcaatattcgtctccctcgttctcactctttgtatgcttaggaatgccaattacttcctcacattatcctgtaaagaggtataatcgatttagagataatgagagtgacctagggaaaaagttattaagccacaaatcaattacaccctatcaaccacaccctcacttgctctccccacctctcttccagcccccaaataccaagaccaaaagcttggaatcacttcatggaaagtcctttgaaaatgatttgtacactgataaaacttcttggaaacataaatcccttgactgatacttgttgagcaagttaaagatgtcccagttcacacctattgcaacagaaccagaaatcactgaaagaggctaagttgtacccgtaagtttggaatgcagagctgggtttctgtcctttgttattcaggatgtatttctttctttcttgggctcagtaagtagagtgtagtaacagtgtaatagcatttgtgttcccaccttcccacactataccccaccccccccaagccatggcatgagcttatatgttagagaaaaaagaaacagcttcggagaacctggccattcgagggccatgctgtctggtagcttctgtgttggcagtgaggatcattgatgtgggtgatgggcttatgcccaggcatgtgtgttcttcatccagcctaccctcctctgcggttctggtttagagtgtgttggtttggggcagtgtgatgatctttatgtggcccccagggccagcagcaggaggtgtctgccatgtcaggggagagtaatgaagtctggacaccatggaatgcctgtgtgcagcctctctgcgcttgtcctcatgaacttctccaacagtcttactgatttttttacaacaaaaattatacctaatgattatctatttcatgtacaaacacaaagaccattttactgttaggattgaaataaaactttttttgtcttcaaattgttttgctctaacacaggcgagatttttatttttaaagacaaggttaaaactctttttctctgcataatttcagtgtctagaatagagtaacagtcctgctttatatttgtataacgcttagcaccagtgctaacaaaatgcaacatgagactgggcatggtgattcatgcctgtaatcccagcactttgggaggccgaggcgggtggattgcctgaggtcaggagttcaagaccagcctggccaacatggtgaaaccccatctctactaaaaatacaaaaaattgctcaggtgtggtggcgggtgcctgtaatcccagctactcaggaggctgacatgggagaatcgcttgaacccaggaggcggaggttgtagtgagctgagattggaccactgcacttcagcctgggcaataggagtgagactttgtctcaaaaaatatgcaacatgccgggtgcagtggctcacgcctgtagtcccagcactttgggatgctgaggtgggcagatcacgaggtcaggagatcgagaccatcctggccaacatggcgaaaccctgtctctactaacaatacaaaaattagctgggcatggtggtgggtgcctgtaatcccagctacacaggaggctgaggcaggagaattgcttgaacccaggaggcggaggttgcggtgagccgagatcacaccactgtactccagcctgggtgacagagcaagactctgtctcaaatatttcaaatatatatatatatatatatatatatatatgcaacatgaactactatgtaatttaaaaattttactagccacctttaaaaattaagaagaaacagatggaaatgattttaccatgtattttatttaatctaatatctcaaaaatctattattccaacatagaagcaatataaaaattgttaatgaaatattttacgtttgttttttccactccgagtctttggaatggcatgtgtgctttacactgacggtgcctctcacttcaggccggccctgtgtccagtgcggtctccataaaggactctggtgtccagaagttcccatggccgctccattccgtacttggttttcacaaaaactgtctcctaccttctaatgtcctcaattctacaggaaaatgagaatcatctccagacagtagaaactgtatccataatccatattatgaagagataaaatagccaattgtactttgtttttttttttgttgttgtttttcttgagacagaattttcctctgttgcccaggtcggagtgcagcagtgcgatctcggctcacagcaacccctgccttccagggtttaagcgatccttctgcctcagcctccctagtagctgggaccacaggcatgtgccaccatggccagctaattttttgtacttttagtaaagacagggtttcaccatgttggccaggctggtctcgaactcctggcctcaggtgatccgcctgcctcaacctcccaacgtgctgggattacaggcgtgagccactgtgcccggcccctattgtacttctgtttgaacttatattggcaaatgtagtaattttctagagttttagaggaggtagtgtttattattataaatatttgctgagaactttctgagcaaagggtactatttattctatataaatatgtactgagcatctgctagttatttaacagacttctaggcacaaaggatccaatggaaaaaataagaatattcatatttaacagcttctttgtgctctaggcattgattattctctgcattgatagaatttacacttgcagctttcaccaaagaaaatgttccacagtttaggcagcatggcaaaaatccatctctacaaaaaaataccaaaattagcaggtggtgcatgcctgtagtcccagctactcaagaggctgaggtgggaggatcgcttaagcccaaaagatcgaggctgcagtgagctgtgattgtgccactgtgctctagcctaggtgacagagccagaccctgtctttaaaaaaaaaaaaagaaaaaatgctataattttacaaaacctgctctccatgtatccctctctactctccttaagatgaacactgggtctggggtgcaggggtgccacagctggagttgaagaggaagttaggagaaggctaggaaccatcacggagatttttcaccctggttccttcattattacttgttggggatcagtgaagattagaaattgatgatggcggccaggcgcggtcgctcacgtctgtaatcccagcacctttgggaggctgaggcgggcggatcacaaggtcaggagttcaagaacagcctagccaatatggtgaaaccccgtctctactaaaaatacaaaaaaaattagccgggcatagtggcgggtgcctgtaatcccagctacacaggaggctgaggcaggaggatcgcttgaacccagaaggcggaggttgcagtgagctaagattgcgccactgcactccagcctgggtgacagagcaagactctgtctcaaaaaaaaaaaaaaaaaaaaagaggaagaaattgaacatggctttacagaggagcttctcttccctgcaggtagcggccttagacccttgtctaaggcaaaagtgggatttagggaaagatactgtggtagctgacacagaattgcaaaaggctgaaaacccccgccagcgaagggcagcagctgctcccctcctgtgggcactctattgccctcatagagagaaggcatctcccagcactttctacaaccacacccccaacccccaacccccaacccccagcttagttctctagaagagcagaccctcaccctcccccacctcctcagcccagcctggaaaggcccacggaaggactctgccagccctggctaaagttatgtgtccacctctagagcagccacctggcctggggacgaagcagtatgagcccacattctgagttgtaaaaccccacaattaggaaatagacttaaagtgctcccatcacattaggatgcaatgtgcatttttgtttgtagaagcttgttctccatttcttcttatttgggcaaaataagctcagtttgactaactctgccatctctaacccagaccccaccatgctctgacactttgacaagcacactggatgggcaaaagagtcaactaccgaaggaagacaattttcgtttggtctaaaactttatacctgtgatattctgtgccatggagagactcgtgcttaataattcactttccaatgatcttaggcaatgtagaagattacaaatactgtgagacctgaactcctccttcagggaacttaacagttttcagtggcgggggaaataagagtagattcctgaaaccatagcagcatccgatagaacagaacatttcctcgactctagcaaatctcttaattccaggtgtactcgggaagatagtagcatttattgggtatatactatgaagagagaagtgtcatatcctgagagggggtttataggcagtaaacattgtagtctttgccttcaaggtgtttgaaacataaaacatgctcacattagctaaatatgcctgcttcaatgcctgtacttatatcacacaaccgacgttatcaacctggtttcaaacgccatgagcaaaaatcaaatcaggtaatgtgtgtgaaagttcattatgactgtaccaccatacaaaccgagatggtattactccagtcagaccttctgttttatagtgtgttccagaagctggcctggttgcagaagagagtgagctcattagccctgttcaaaaaaaaaaataaatggaataataaagaaacttcaaaaccaaatgaaataccattccatgcacatcttggaaaagtttataacgtatttaaacatgaagagctattgtaagcttgacaataaaactgtgaggatattgttcatttccgagattcacttttccaagatagctctatcgtgaaagtctcttttggagtttatgtatagttctttaaattggcacagttggcttaaagctaaaacactgtagtttgcattaaaaaagaaaaaaaaaaagcaagtgcttttgcacaaaaggctgtaagaaatgagggctgcatatgaagcgagtgttccgttgactgtgtgagtgtgagatccttttggctttagtcatttatttggggcaagctccgaccttgatgacagatgatttcgtcaagctctccacaaaaggtacatgtctattttcatcgtcaactaacttctgtggagcacttgctgcttttggtcccctaaccatgaggttttattgacccatttgccatctctggggtaagtggatggaatcatctttcttgagaggagaactccaggaataatattacacttgtctctgagccatttgagcttgctatttttacagatttcagccttagttccttttcctcttcctctgtcaccctcagaacactgggacaagggggagccatgctgtttcataaacttcccatagaggttctgagtctcctttttagctgattcccatgagtttgtaatattttgatctgagctggttgcagtttgaaataaataaaagcaatctgatttcattctagccaacatctgatgggtttgatatggatgaaagctaatgagaggtacaagtgagacagtacaggtgaaaactacaaaatctctcttgtaaaatacacatatacgcagacccatattttccaatgacacttaaaaggagtgataccaagaggaaacactgagtcccatgaaacatttcttcaatcaggacagaaccatgagcagaggacatagtgggtggggttcgtggaaaaatagaatatatatctaattttctgtttgatgatggtctacggattgatttaattatgattactacagtaacttgcctagtacttcctgttcacggttgccttttacatgcacagcaggttgcttggggagctgatgtctgctcctagcctttctgctccggtaccctttgttctgttccattatgtttcagataatttaatcaaagttgtgtttgcttgtgcgctcccccctttgaatcattctcactgcacttctgccccttccatgcagatgcaggctgatgccggatgggtctccactggcctcttctctggacttctctggggcccgtatcagaacccaaaacctagcctcagcttgacttcttcctcttaccacggggtgaccccggtgtgatctcccctcccaggttccatccagcatgaccgccgggtctccctctgccctacttgattgcactcaccttttgttaccagtccaggcagcaggctccatgtctgggttgggggtgtttcctggcctgacggggcaccttgttcgtttcacccaggcaggaaatcacgtcttgtttcaacatcctgaatcttgtcctgacgtggaaaccgtgatgctagctgacctgacctgcagcctcaggcatccctcggccctttcatggcctggtgtttatgtggtccgtcctcacaaactcttaggatgggatttattgtctccattttcttttctttctttctttcttctttccttttgttattttttttttttttttgagtcttgctctgttgcccctggatggagtgcaatggcaccatcttggctcactgcaacctctgcctcctgggttgaagcggttctcctgcctcactcagcctcccgagtagctgggactacagatgtgtaccaccatgcttggctaatttttttatatttttagtagagacaaggttttaccatattagccaggctggtctcgaattcctgacctcaagtgattctcccaccttggcctcccaaaatgctgggattacagatatgagccaccgtgcctggcctacagtctccattttctataggaaatgaaagcttagtgagagaaggtgcccagacccccaatggctgcgaatcggcagagttgggccccagtgggtctcctcactccatcccccttgtaccacccagtgtctcaccagccattctgctcagatgggatgtagggcctatatagcaaatagaagttttctgggaaccccttaatgacaaaaaatacttgctttccagagtattcatggcaggccttgataatcttgagcctcaagtgcccacaattccttctgggactgactttaaacctttatttcaaatacaagctgggtcttcattattctttgttgcaatggatctctttacacgttaccctcagaaccacaaattagcaagagtctagctggaatctctcctgtgatggaaatttcattccctaagaaatagagcaacctttcttaattaggcatttactctaatgattcagaaagttggttctttatttttgctttattttcattagaaactaaagatttggatggtgttttcataatctattgagaactgcaccaagactgtcagtattcaatacatatgattaataatcagagggaagacacttatattttctgtcatacacacatacctaaatgtttaggccaagggcacatttttaattgattcaaatagcaaatataaattgtgcctctctgttacctgaatgtcttacttttttggaggttttgttgtcaggaactgccatataagaggcatgcatcattttaattgaatcttaaacctgacacttttattgaccaaaaaaaaggatttcaagttatttttcatgcataaagcctgcatgaagcctgtacttctttagtgaaggctatctcagatatgtatgaccttacctccttgcctttaggaaaaattaaacctcactgtctgagatccttgagatttggcaaatgttgatcaattaactcttcaaagacttatgatgaaataactgtaggcaataaaacatactgaaatatgtccaaatgaccagcacagcaaaatatgcatgaccctgtgcctaaggtctgtggcatacaagccttgggttctgtttatggggatgtcaccttctatgactcaggtccctgtctagaaacatgatatggccacgtcttggtggttccttatttatgcggtcgagtcttttgtattcttaagtcatctctggaggataaaagtcagagctcaaagtctatatatactgtcacaaaacaaggatgcagatataatgatgataaaattgaacctatgatttaagaaatgcgatatgaatatgatatgacaactctacctgccaccagtggactaatttcccttgttgccaggggagacctcatcctcatcctaatttacacagtgttgtatgtttgtcaagaatgcataattctgccagtctgttgtatttctaattttagcctgtatacatagaaacactttaaaacatttgcaggctactgcaatcatcgtcatacaatctgtatagttgttacatagaaataatatcagttggtttccccataataattttttctagagagctagctgttcaatgctaattcatatcctttcttaaggtatatggcaagtaaaatggatttcctcggggcctggaaggaattcctgttcaatgattggaacatttaaaagatttcctcttgatttcctacaaggaaggaataggaaagggaggtgattggtcttgttagcctggaaatagtattcactgggtcgctagagggtgggcagagagggacgcaaaaaggcgtgtgtcagagttcctgtctccggggaggtcacaggatcgttagacagataagagagacgcctgtgtctaggtgtctttggttcagtcctaatgttctgcttggtgtctggttcccacaggtcatttggggggtctgaatggtgatggatacctctcagagaaaaaaaagatttaggcttccaggcaaagtggagaatgaagagtaaagacttggaatgatgggtggcaggataaaatagaagaatcattagttattagaattattagggtaaaaagccgtgttaagtgctttgtaggtaggaggaccgtatatcccaatttgcttaggccagtcctggtttatggcaattgccctgacttgagttttagtaacattcccttttattctcaatagcgtcccagtttgggcaataagtcatatggtcaacatatatattgatgaagaattaggatcttaatataggaacagattgcgagtgaagataaaggtaaaatcaattttgaagtccccttatactacaccgtaatttgatatctatatcaatctctaattttacttgaggagtagtgttgacctcatgtcttagaagaaaaaaatgaaggtaaaaaaataataaaattttgcttaggccgttgtgaaatttcctttcaaagacggaactagaatttagaactcaaaaacctcatttcctatactaacccccaccctacattgccggggaaaatggaaaaagcaaaagaaataatgggatataaaaatgtatgggacacattctttcctctattatgagcttgtctcttaattaccaccatttatactggacatgtgatttgggtttccagaatagtaaaaacacagatattataagccctgtgatcatttgcaaagaaatctcatttgcccaggctattacatttctgttctgccttcagtggaaatacacatagaatggaatagaaatatgcattactatgagtaattccagacaccttaatgcttttagcgggagtgcatttggagtttgtttcctgagacccctctggtggaggtggttgttattcatgcttgctggaacagtcctccccacgtctgtgagctcaagcaggtcctggcctcagaaccacagaactccaatagccagagactaaaagaaaagggaaaaatggtttgctcggatccctgggttgcttggcccacaccctgagtgtaatatgtgatcagggttagaaagcaagtggtgggagcaggtcttgcttctgtgggcatggcctcctagagaaatagtccagcgctggaggcacagagaggggaggacaggcattccaaggctcttgaagaactgaaatctggaatcgacatgaagctacatcccgaagcagggaagtaacgacgggcctggaagggattcctgttcaattagtggaatatttacagaagtgttgttttgaagatgaatttatggatgatgttcatgtaaagtgagatagaatgaggggacagacagggatagggaagcaattaatttgccatagatgtgggtctgaaaataatctttactggcttgcctggtgttgtctaaagtagcaggggaagctttgagaatcctattgatttcaggttactatccaggaactataaaatattaaagcagaaaggagacttagtgatcattaaattcattctgaaatgagaaaaatcaagcccacagaaatggagggtttacttaatggagggtgtacatggtattaggggcaggaaccaggtctagaacacacccactggctccttgtcattaaccccgttgccctggagagaagagaagccggtggtcacactttgacagacacagtgtgggtgatgccagagccaaaaccttgggaagggaactgtgtggcttcatggacatgaccagatccacagtcatccactgggttactgtcttcccagttctcatcagccagggttgtttagaaacattgaaaaatgttgctaactgtggatagctctgtaagtagggttttccatctttctaacacttattacatttttttattcctggaacaattttgaatgagaagtggaaaccatggttttagccctacttatctcttaaggaagaatagattggaacagtacaggtgttttgcttaagtttgtggatttacttaaatattccctatgaaagctccggtgtacacatttattttattcatgatttcaacaaagctttactgtgcaccacatacagtccagcatggtcccatagagctttcagcaatggtggaattgtgttgcatccgcactggccagcgttgcagccactagccacatgttgctgtcgcagtcttaaaatgtggctggtgatcagggacgatgagcttttctcatatatctgttggctgcataaatgtcttcttttgcgaagtgtctgttcatatccgtcacccactttttgattggcttatttgttattagagaaatgcaagtgaaaaccacaaggagatactatctcacgccagttagaatggcgatcattaaaaagtcaggacacaacagatgctggagaggatgtggagaaataggaacgctttcacactgttggggggagtgtaaattagtttaatcatggaagacagtgtggtgattcctcaagggcctagaaccagaaataccatttgacccagcaatcccattactgggtatatacccaaaggattataaatcattctataaggacacttgcacacatatgtttcttgcagcactatttacaataacaaagacttggaaccaacccaaatgcccatcaatgatagactgaataaagaaaatgtggcacatatacaccatggaatactatgcagccataaaaaagaatgagttcatgtcctttgcagagaaatggatgaagctggaaaccatcattctcagcaaactaacacaggaacagaaaaccaaacactgcatgttctcactcacaagcgggagttgaacaatgagaacacatggacgacacagggaggggaacatcacacactggggcctgtcgggcggtggaggggaaggggagggagaccattaggacaaatacctaatgcatgcagggcttaaaacctagatgatgggttgataggtgcagcaaaccaccatggcacatgtatacctatgtaacaaacctgcacgttgtgcacatgtatcccagaacttaaagtaaaaatttttaaacatgtggctggtgactgagagatgcaattcttaactgtagttagttctaattaattgaaattgagatcaccacagatggcagaggctttcatgtcagtttcagactctggtattgggtcgagggagaaaagaaaaaagacaagtcatgatctctgaggacaaggtattcacagccgagagtggcagggatgaggagagacaggtaaacaattgtcacactggagtgtggccagttatgtcactgtgggaataaggtcctgtgagagcacggaaaagatgagcgtgatatgattcctctttggggcgggcaagcatcagggcagtttgacaaagagcagatgttcctgtctttacgaacggactgagaccgctccagacatctgagatgaacatgaagagaaaggaattttcaacaatggagcaaacatacattctcagcagtgtaaagagcagagcgccagaggcaaccgtgtacttctggtgtacttctgcgtgcacgttggtgtacacaccctctggggaggtgaactagcaggcagcttggcaagaagtcgcctgcggtgttctgcgtctcagcccttgttcaccatagtgctctgtgtgaagttggacaaatgcatctacctttctggacttcagtctcctctccactccccgaaggcagggcagagcagctgtatgactccttctcagatctgggcttagtccttacaagcttctgttgcattctccagctcctgcagtggccttccctcaagacaatgagaagcttcttggcctcctctttaacactgggtgctatttaatgagggcacctcaagatcctcccagttaccacgattgctggtggcagtcatctcccctccgacaacagttttgtgctctgagtgcctgtgctgtttccacatttttttctccccctcaggtattttagaccccaaagatacatgggtactctagggatactgtgtaaagactgggtagtatttggaactggcagccagagagacgacattggcaattcattcatctatcattacctcaattggcagtgttctcagtacgcagggactgtctctgtgtggctttttgtgagagggatgtaagatttatttttctctatgacctacctgctggcatggtacaaaaggtctctgccgaggtctgagggacctcacttgagctgcactaatagacggggggataactggtagaccaggagagtgtagacaggaagaaagaactcacctttgtaaatgagccactcaggcttttgattttgtggcccttgaattcccacttcagctgatggtcacactcatctgtggggaagctaattttacaagaaatggaacaggagggggttgctgttggatcaagaagatgcagctttggaaggtatccacgagggaatagccatcaatttgccacgtgtgtgagctctaccatcccgcagcacatgggagcgtgctgtgctgtgcctgtgtgctctcaaggtagacgaggtgtcactatatggtcatccacacagcaggtgtggccaaatatagagatctcgtgaaaaactaatagcctgccaaagaatacagccactttttcagggtcgtaaaaacactctgtgactttcccaaaatacagttactatacatgcactagcaaatcccaggatgttctcttcttatggtgcacatagctaaatacccacctgtggaatgtgggtttatttgggaagaagctaatcctattaggagtttcatattctcaccaatttgggtgatggggtctgtgaccaaagatcatagaaagtaagaaatacaggactcaaaaatgtgttcttcattatgtcttcacctcgtgctttttaaacttttttttttttttttgagacagagtctcactctgtcactcaggctggagtgcagtggtgcaatcccagctcactgcaacctccgtctcctgggttcaagtgattctcctgcctcagcttcctgagtagctgggattacaggcacatgccaccacgcccggctaatttgtgtatttttagtagggacagggtttcaccatgttggccaggctggtctcaaactcctggcctcaggtgatccacccgcctcagcctcccaaagtgctgggattacaagcgtgagccaccacacccggccatggttttcaaactttaatgtgcatggaaattactggaagtgtttgttaaagtacagatgctgcttcagctggttgggcataggtcctgagatcccgcgtctctcacgggctcccaggccatgcagttgatgttggtccatggatgaccctctgggtagcaacgtttggggtctttgtgtgtccacacatggtgtgtctgtccattaggaggaaagtgccagcgcatttgccaaagcgtttagataggagcctgttagagtttgaagttccaggaccaaggaaatctggtaaataaaggacagttgtttgttcatggatctaggtttataaagtgtgtatacattttgagattctgtctcccccctccaaccttaaaattagcaaaatgtagtctttctttgtcgagctctaggaataatttttctgcgtcagatgcatttttgggaaggtgcgtttggccatttcccactcaccgtgcccgcccagtatccctgcagtactttggaagcaccataattgggaaagagtagaaagttcttgccttggaaatgagattcttatctgggtcttgggcactggaggatctcaggcgcgggaggctcgcgatgggtccggggaacagctgctgtgttcctgtaggaggaaatgcctgtgatggaggcttctaaagccagctcccgtctcagagaagacagctctatgcctccacgtcgtgatagcaaatgttcccttttggctgttttaatagttctgcttcaagcgtatttgtttttccttatttcctagcatctttgagaaagatctgttctatactctgtagcccagtttggagagatatgacatgtttgactatgtgaggaaatatacatatttctcagggcttttttttttaaattgagtgttattggactttgatgtttgatttccaggcagtctttaatgtgaaaggcaaacacattcattttctatcagttcctgaaaatgttcccaattttagaagctctagactggtcttgccaatatagcaacatagtgacagttactcgtctgtaattctgtacttaaatcgtgaactgctagcactatcgattaatgctttatacagtttcaaagctgtactcccaggctgcatttagatggtttaaagcattgatttctctctctgacaactcttaagttattggctgccaaaaaaatgaggaaaggttggttaatctccatggctcatatgttgcttgctgtagagaatattggtgaagcatagtttttcttcattgtaagatgcactagggatgtgaagactgttttgaatcattgtgaaaactggaatcagaaaaacaatctcctcattcaattcaagaattcgagatccaaaacaacattcagtttggtatttggcagtttaaccaatatctgactttatgtaattttaattattggggtcagccattggtattgcattataatttgtaatgatttatatcagccttttaaaaatgctcacagtcatggacaaaactggaaaaaatgaggaagtaacccaatccaaattacttaatatcatctgctgtaattagaaattagattttagtagactgtttccataatacatttcagaattatttttataacttaatagtataaatacaaaataatttcagctttgttattttattatgtgctgtgctagtttaaattattccggttataggtgtatcatcaacaccttatcttcagcaaggattttaaatatgggctgaccaaatttatgtggaatttgcattttgttattcgtttaaaaacatacagaaaatggaaaaaaaaaaaaaaacctttgcaaagattctcttttgagtgctagcttttcctgatccctaaggatgccggctgctctgccaggaatgtgcccttcatattatatcttctagaatgaatgtttggaagggaaagcagtaagatgcaaaagcaagaaggacagatgatgttcatactcacagtaatagctgtctcccctcttatcagttgtgatgctggaacaaacacctctttcctgactgcagggtttggaggtccccaagtccaccctcacttctgccatcaatggcaagcggcactggctgcgtggaaaagccaagatgcctttcaccataccatgtctggagtctagttgctgctcaataaaccctggtggcgatcactctcgagattcagtaacattatccagaatttaaaaaaaatacaagcctgggcacagtggctcacgcctgtaatcccagcactttgggaggccgcggtggcagatcacttgaggtcagaagttcgagatcagtctggctaacatagtgaaaccccatctctactaaaaatacaaaaaatagccaggcatggtggcacgcacctgtagtcccagctactcaggaggctgaggtgggcgaatcgcttgaagctggtaggcagaggttacagtgagccaagattgtaccactgcactcagacctgagcaacagaggaagactctgtctcaaaagaaaaggaacagaaaaaaaaaatacaacaatgtgtggtccttgtattcaagccaagcttatttctgcctcaaagcattgtgccaagtttgtatgttacttcaggtttcataagccagcagatcctcttcctgggactgaaatgatgatttcagttttttcaatgcttaagcgtggaaaacaggcaggtaatttgtgacccataagggaggggtgagaaccacatgaagatgaaggtggtggaaaggagcagctgatgtcacgcactgtctacttaacattgccacgttaatgttaatgccggttatagaaagcaatgggtaattgccatatttttgttacggcttattgcagtgaatgcaggatgcttctcacatctcttacacatcaagtaagagtatttcttaaaaaacaaaacaaaacaaaacaaaacaaactctcaatgccacatatacctgaattgtgagtacttatttcacctaacaaatacctaacaaatattgatattttgccacttatgggttgtataaatgaccattaatatgatttgtcaggcacagtacacacaactaacctataaacaatgtgcagacgtaggtcataaactgtgacactcgaaatccaagtagtgcccctggtgggagatgtttcacatgttaataagcaattaccgtagtagattaagagtacagaatcaatccaagaagccaataatttagagttggatactgtagcacaagattgcaggaacctgagtgctgtgtgccacgctgcacatcagaggttgcaagatgtcctgcaatgcaggctcaggaaagtgactgatgcgctgtgttctaatgtggaattctacaggtattcgtggaaaaacatcaatacattagcaaaacctggaccgtttctggtgttgctggtgctgcatgggatgagtctgtggggcactccatgggatatatttaaagaggtgttattttgtctcaagcggctagggcggagatagagcatgctatttgccacattgcattctaggggttgcaagacatcctgaaatgtgggctccatgaaagcggttcatgctgtgatctgtacccccagatctcttcccaggcaggtctcatccaccaccagaaatggtccatgttttactactgtattgatgtttttccacaaatacctgtagaaatccatattagaacacagggcgtcagtcactttcctgagcctgcattccaggacatcttgcagcctctgaaatgcagcgtggcacacagcactcaggttcctgcaatcagcatgcccacatggtcataatacagacttagcaacctggaaggaagtctcagtgatctgtgacccagccctttctcctgatagaccgtggaactgcaggcagaagatgcacggcgtctcatctcagatacacagtggtggtgccgggatggtatgtgctctccattctccctggagggctcttggtccatcttgcttcagtgactagcatgagaggagtggtgatagcagcaggtgccgtggccactgggcaggcggggtatggagaacgcagccacacggccgccactcctgctatggaggcaccaggtcccgcaacactggtaccataggacagggcttcctggtatcacaggatttgccagagctggaacgtaacgcccacttcacaccttggagtatgattcaaagtagagtttgtagtgaattccaaaaggcatgtgattcaagctaactgccaagaccattcagagttgtggggagaaaaccccactgtgggcacgtgagtcagggaagcagcatggaagcggcttgggtaggattgtggcaactggaagggagttgggcgggccatggttacagatgcgggaagtggtcggagtggggaagaggacctgtctgattcccaggaagtgggcaggctccatgcagagcaggatcccccgtggagcctacacagccttgcacacctgaactgaggggcaacgaagaaggggtctttgtagttcccttggttaggcaagtcaccagctggaagtggcagccgagacccggcagggacaaccctgtctttcccagtgagcatctgatgatattatccggggcccgagcagctagggtagaaaaggagaagcatttaaacatcagtgcctcaaatctcctttccaaacatcccaggtatagaaagttacatcactcttgcaatttggttcatcaattgtcctcactgcaaagttgaacctaaactaactcctgttgggaggcagactagggacaagtgactttcagtgatgctgaactgtgaggctgaggcactggccatactgcctcccaaatggaaccctcgtttgtgcaaatgcccccggccagggtggtacccacacacatctgcacatgactttctcagtctcctcctaaattatccctattctttttgaaaacataaaattaacccaggtggaagtttgtgttgtaaaacatggagtagttttcaatattgtaataggctcttcaagaagagcagcatttgcccacaatctgaatttttagaaaacgtctaaaatctcgagttatcagcaggacgatatccacacagtagatacatccctaccggactcagtggcaaattatgacacaggccaaggtctatccttgcaccatctgtcatttctgagtcttcaaagagctcagagatgtcctctgtgtgcctccttacccaggcaggcagcctaaactcccagggttcttcccaggcagatctcagccatcctgggctcaggaaggcattccaggaaaccagaacgcaagggataaaagatggaggaagtcacctcttttagcagagtttgcactttgatgagaatgaaggctcacgcccagggagaaggtggataagagagacgtttaagcaccagctctaaggtagttgcagtttgctgggctgatttgggtgctcctgaaggatttgttgtctggggactcttgcctggtgcccaaggctgtaccttcttgcgcgtaagcctgttcagctctcggcccgtgtggcatgcaggccacaggagaaggtgactccagcccctcctccgttgactgcatttctcactgagcgtatatctgtcttgccttctcgcagattgttttcacgtggcatttcacttaactttagtctggattcacattttttttttccagaaggtgagattcttcttcaccaagatgtcacagtttgggcaaagttcaaagttgcttaaatttcttcgaagggctccatgagcagttgtactccagcaggactgtcactccaaattggactctccagctggtcaggggcggctttccaagaatcttgatgtcccagagcccctctgatacagtatctgaaaggccttttttgaatgtttggaatgctcttgtctgagagatatcttaatatgaaagcaaatacctgaagcataataaaagcttgtaaagcatcaagaaaagaaacgatctcaggaaaacctaatagtaactcgtgatccagggacatataaaactggagatacaccgtgaaataaaaaatgtcaggtacttaacagcatgcaaatgactgaagccaaaagaaaaagaaagaaaagaagaagaaccaattaactatgagagtctgcatccttccccagggccagtgttaatttccatcgctgtctttaagcacatcgttttgaaagagtgtgctcgggttcatccatcttatttcttctgttagcctcagaaagggagaaagtaattttcctacattgtcagcttctttacaaatgtctgggccttttctaaacagaacccccattgaatagaggaaaacaaccattctcacactgaatgccctctttaaccctaaatgcttattcagtcatttagcacctctcttcctcgccttttttcccttctgaacatgacctgaaagaagatgttggaacccccctgcatggcggcgggtggcattgccctgccccattcatctgcgcgttcatccgtttctcttacggagcagcctcaatgctctaccgatgtgcgggtgccaatctgtctccccgaggttattcagcatctaacgttgctatttaatctccagatttctaaacttgcagcagactggctgtgaacaggccagattatttgtttcctcttaaaataagtgcttgatggttgggttgtgtggggccggtccttggtggtcactgcatgtaatcaacattcatagactgtaggaaaatgtggtttaatgaaacattctgccactttttcttctttggcacgcgttaagcagtgcgtgcaatgcattgcaaatgcaagtaattcagagtttacaaggaaaggaaggagagtgaggaaccccagaggacagggacgtggggtggtgggacagggcttcaggctgatttatctttcatacagtagtttggccagtgggaacgcggagtgggaggaggctgtggctgcctgctcttcccaatggggaggaggctttacggtcctctcagcggagctggtgtttactaaaaggtctttcctaaagagcccaccgaatagaaaacgtctacttcccgtaggctcctgagaagcttcctgaagtcagtgagcacgttctgcataaaagctcatttgaactctgcactaatttgcctagcaattcataggaatcaatcatctaatattcagtccccatctaatgaatggctgcttaaacacactagtttttttttttcattgcattgggttaggaagtttgcagctggtaaattaaaataggaagcagtctttggtatgaaagtggcatattttaagtgccttggaatgcacttgttacaagtgctctgctgttatgtgagcagtagtttaatgtggttggctgggcgtagtggctcacgcctgtaatcccagcactttgggagcctgagatgggcggatcacgaggtcaggagttcaaaaccagcctggccaacatggagaaaccccgtctctactaaaaatacaaaaattagctgggcatgggtgcacacgcctgtaattccagctactcgggaggctgaggcaagagaattgcttgaacctaggaggcagagtttgcagtgagccaagattgcgccactgcactccagcctgggtgacagagcaagactccacctcgcaaagaaaaaaaaaattaatgtggttgaccattagaaacacaacatcaaaattgttttggagccatcttagttggttaagattgatgtgcaaaaatcaaatatttggcagttataaaaggacataccatagattttaactaatctcttttatgtagagagtggcaaaaaatcttaatgctttaatgaaacctactttacaatcacgaatgttatttgtattctgtgaacatattgcaatgtacaagcagctgaacaatgaaataaatccaaaatccccaaacacttcccagtcagctcagcctcacaggtgtccattgggtccttggttctttgcttcctctccatccccagctttcagcacattgctgtgtggccgtcttgaaggaaagcccttcattctcttcaccttcgctcaggtttcctggctcactggctatggtgaataatttatccctctgattttaatgagtgtattttattgtgtttttaaaaagtagggacccaaactgatcttcatgctatctctttgtttaaaactatatttgaaaaaaatacttccattaattttttagatattgaatccagaagcactggtgatagcagcaataactaacatgtgtttttcatgaataggtggcaattattgcaaaaaaatgctttacatacgttattgcaattaatacagccaccaccttagtcgctgttattatacctaccttgccccagaacagtgaggcttgagcagctaaaaccacttgcttgaggtcttctaggcagggagtaccatgaaacccgtgtccactacagaatgcctggcgctgctctttttggctctgagtgtgcttacgattttttgaaaaacatttcccttgagacatccttttcttatagtatttgtagttttttcagcatatataaatatataaattgaattattataacataaacttataaattacattctctaatgaatggattcaaggctcctggcagagatactagtttttatgcttgtaatcaatcacacttaaatatcatgcaatccaaatgctaacaaaattactctgtccccatttggcatttagaaaacatcaaaaacatgctgatgatgccaaatagggtttttaagaatggggcgaaaggtgaaggtgtcaagtgcagcgaggattcctgcagctctttccttgtgtgggggtatgtcagcgtcagtgcaggctgcggtgtctggctctgtccttctgacatctgcggtggctgtggtccacctggagaggtggttatgtaggactcagggaaatacataattgtgagcattccatttattcaggttttagaaatgaaatctacaatcgcatgtgcctttctcatactctgtagtcgcagatctgatgagaaaagtgagagacagaacagagaaaaccctcactcctgggtcgggctttacttcttgactgtccaaaaaaggaaagatataagattttgattctttcttggaagctgcatcattactttgctttattgttcaagaaattgaataataggattatataataataatatgtaataataatcctattattcaatttcttgtcccttctgtttagtcttggggtgtgtatgcatgtgtgtacgtgtgtttgtgtttcacttttctccttgatgacatttaagactgcacccatttttatgttccaggtgttgtagatcttgtcaaaatggctgtctgttccttggttaccttctcctataatgacgcaagaagaatggttgaatttaaaaggcaatacatttagaaccaattaaagagaacatttttagcacagggtgtggcgcttacaagagttcataaaaaccgaagttgctgggaatgagttgccattcacctgcactagaaactatggacttgtgtcaacgatgggtcctttggggaggaaatcatctcatcacctgtgattcttttcttgttatcagagggagaaaatgttggcacagcttccctctagaaaaagatattgttaataattggttaattatgaagactgatgaagaaaagacattacagctgagatggttgggagggagagaatgtctaggctgtgaagcaaaaggaactaatgattagccagcagggtctgacaaccaggttacggtcagcagccccaggatatctgatcgtgtgggcacagcatggaaaggaatgcctctgaattggcctactaagctgaggcagaacaggcagacacactgggatttgagccggggatagggtgtggtcaggtggagagacagaactgaggccttcacatgtttgggggttctaggagggacagattctgtccagcctaccttttctcaatgcattaaactttggcaaagtaatcaggttgcagaagcaacattagagtatcctcctttagctgctgagttgggggtgaagtgggctgtaagccccggggcagttttcagaggacaggctttgagactgcctgaaagattcatcaccttaaggataaatttcctggaggcgaactagaagatcctgtgcattaacagaacagtcaatgcctgttatccaggaactgatgtgaacatctgacagcttctgtacctttcaatcttcaagcactgcatggtgaattttgtgatttaaggaaaccataaatgaattagatcacttttttccttccaaatgcgagattccaaatgacagcagaatttccgtccacttcctaaaagttaaaggtagaactgcttgagtgaggctaccagtgctgaactggcaagccaatcgtggccaaagctctcaaggtaaactgaaatgatcaatgtatttatagtaggataatcaaaatttatttattaaagaaaccaagatgagaccaagagcatccagtggccaatattgatgtgcctcacttgaaggcatttcaaaccatctcgccgctaaccaaggtacagcaagattgttcagctttgctgaaaatgacttgaccgtagatttgcttctggggcaaatggattgtaaattgctaaaatgacactggtttgaatggcctgaaaagaggaagggaactgctgcttccgtgttccctgagtgccttgtgtcattacctcatttactcactgcaacgccacacactttgtggcttcctgattttacagatgagaaaaccaagattctgaaggagtatgcagattccccaaaggcacacagctaatcagcggtggagcgaaattccaaacagctccaaagactgcctgtctccaaggggcatctcactgcatcttcgcaagtgcacaggcagcgtcagtccgggcactgaaactgacagctgctgcggtcttgattttgagacagtttgggtctcagccagtgctattcagcggcttgaagtccaaaatcacacccgtgcacatgtaggattgttgtctcacgtatcagtggacctgtcccctgcagggaagagttgataaatatggcactctgcttcacttttcttgtttttgttttagtttttgtttttgaaacagagtctttctctgtcaccctggctggagtgcaatggtgcgatctcggctcactgcaccctctgcctcctgggttcaggcgattctccggcctcagcctcctgagcaggtgggattacaggcgtgtgccaccatgcctagctaatttttgtattattagtacagatggggtttcaccatgttggccaggctggtatcgaaatcctgacctcaagtgatcctcccgccttggcctcccacagtgctgggattacaggcgtgtgccaccatgcctggctaatttttgtattattagtagagacggggtttcaccgtgttggccaggctggtatcgaaatcctgacctcaagtgatccgccagcctcagcctccgaaagtgctcggattataggcgtgagccaccgtgccccaccctctgcttcacttttctactctaagttcttttaaaagaaccatgacatggcagaagaagagactgatgaaaggtaggcaggaggggcactgccctgtctttggtcccaagccttttcctctcttatctgcagtcattcctgttaaggttatttccttgggaaaattccacacccacaattgtctgttcccaagcacaccctcacgtctgtgttctaacacccgcttcttacctactttctctcaataacaataaggtaagaagtaaattttctaactggcagacaggcgtatgaaaaggtgctaaacatcattgctcatcagagaaatgcaaatcaaaactgcaatgaggtatcatctcaccccagctaaaatggcttatatccaaaagacaagcagtaacaaatgctggcgaggatgtggagaaaagggaaccctcatacgctgttggtgggaaggtaaattagcacagccactatggagagtagtatggaggttccttaacaaactgaaaattgagctaccagggaaaggttttaacaagagtactgctaccagctgtaccagcctgcgatacatgctaaggactcaggtgctacgtgagagagatccagttaaaaccccagcttcaagatttaggggctgtggaagcttgtacgagtttcttggcaactctgattcacattttccggtgagacccccatctctactaaaaatacaaaaaattagctgggcgtcttggtgcacacctgtagtcccaactactcgggaggctgaggcaggagaattgcttgaacccaggaggcggaggttgcagtgagctgagatcatgtcactgcactccagcctgggtgacagagtgaaactccatctcaacaaaaaataaaagatgaataataacctccaagtgctgttgtggggattaaatatgagaatatgtttaaatgcttaatagctggcacttaaacataagtggaaaaagtgatcatgtgaccgctcggcaaatatcgctggtaccgttagttggtttgggctgctataccaagataccatagactaggtggctcaaacaacagacatttatttcctgaagtttcctgaagttctagaggctgaaagtcgaggatgagggtgcgggcagctttggtgtctggtgagggctctcttcttggtctccacaccgggcaggaggggagagagagtggaaagaggctctcacctgtctcttctcgcaaaagcactaatcccatggtgagggcctcaccctcatgactcaccacttcccaaggtcttaccacctgataccatcccactagggtgacgatttcagcatggaattgagggggcacacattcattctatattttagattgtgctacttgcaaataatttcactgctggaaaattctgaggggctggtcaataggaagtgcatgtcattgcaattcttatttgcagtccattttcccatgggttggaaagtggggaggaaggcatcctactggtctgggaagatccatttgctgatacaggtaagcagatagaggtggatttcccaaggtggaaatcctaaggtggatttgcttagtcttgggacctgttgctgtccacgcccctaccttgggctttgctgttcctccttccgccccacattggctgagagcccagaggtcagctatgcttcccattctgtgtggactctgccatatgcatccataaaggccactgccagccacactctgcatccctcatttatggtccctggaactgggaccctgtctgtgctaccccttgcttccttctcctgatgtttccaactggagagggagaggacattctcattccagagcaagccctgctgctccctcgttccatccatcatttcttcgcatgcaaagtaccttctaaatgccaccagaaaactttctgtcagtcagacagacatgcttttgaactgaaacatactttgattagggagcaaggtgagccgattctttctgttacgtatcagcaaatggatcttcccagaggggtagaagccttcctccccactttccaatccttgagaaaatgggccgcaattaaaaagacaagcacttcctgtttaccagcccctctgaattttccaatggtgaaattatttgcgagtatatctcactctttctcagaggttggcccagactcccaggataaaggaaagaccatttgggtcttcacatactgggaggaaacaaaactgaagacttttcaagcctctcaaacctactttacagtgattctctctttcatctttctttttttttctttgagatggagtcttgctctgtctcccaggctggagtgcaatgaatggcgcaatctcggctcactgcaacctccacctcccaggttcaagcgattctcctgcctcagcctcccaagtatctgggattacaggcactcaccaccatgcccgtctaatttttgtatttttattagagacgaggtttcaccatgttggccaggctgctcttgaactcctgatctcaggtaatccacccacctcagcctcccaaagagctgggattacaggcgtgagccacagtgcccaggccctccttcacacttttaattgggaccccccctgtgtcttgagggactctgagtggcattacagtggagtcactttgccattaatcctatcactgagagcaccaagcaggtgttcatgcccaggtaggctgagcatctgtatcaaggcttcctgagctttcctgtgccttccatcgtcacttattttactgcaaaataacaaatgctttttggggatacactaaagctaccacacatttaatattgactctggagtttcaagtaacttaaaatctactaatctcagtgaactttcgcccagagtataatgttttccattttctatttttcctttcatgtagttctactctagagatggatgtgagaaagataatacaggaaccatcctgtatctcagcaaactctactgaaatcagtaggtatcatgtatgtgcatgcacgtacacacacacacgtgcacaaattagccctgtaatgttattccatgtcagattgttgcctttggccaaactcagcgattgtgaatgacatctcctgctcggttcatgtaacgtacaggagacctgttcttagcatttaccattatccttccagtcttgactaaggttgggtgcacattcacagagactaccaactctcgattcagggtttgaaaagtctgaatggttgtgtattaaatggaaaagatcagaccaatattccctagccttggatgaaactgtttgtttgcaaaatgatgttttagacagaagtgagttttcagaacattaaaagattccagtgataatatttgcaaatcctttcatctgcatgaaaatttagcaactaaatctggccattaaagcataatctttatttgaccaaagcatgatataaaaatggaataaactataatttatctttgctgacagctaattacctggaagtctgattaaagggaaaactaaatttacttaattagtgttttggtgtttaatctgtatacatataaatatgcctatctcctctcctacatgaacatttctagaaataaattaccatttttattttgtccctttcagatgctgccaaactgagggcagcattagaagaatgggtattttagcaacaatggtagcaggtgtttgtagactgtgatcccattagaggagcagagtgaggtaacacaagaatgggatgcttaccacaaagtagttttcttttttccccaatggctcctcctttaactgtgaacaagaagagtgccaacttgtggagtgaaccagccctgccaatgaatcctggcttggtggtggaaaaatctgcatataattaagccccttgaggcaagtggactttgatagacaagaggtggctttgaaaacgttgaaatcatttgttttttagcagcagtatttggcagtgttgccttttgacggtttgaggaactatgctgtaagtacagccaaaggcagaggaggttttatggaactctcagctcccacccccacctcctgatgctgcaaagttctcccactagatgcaatttaaacaggagacatatgtaacacacctcaggtggtgtaatgaaatcatcctcttttctgagcttctgaaagtcaaatatacttatattaattttttaaagtgatctgaaagtcatacgattctattcttgaaatagagaggttttcgttacttaagtggcagacttactgacagttcagttataggcttacaaataattggactaaaatatgatttttataaagcattgtaggttttaatcaaaatccctacagaaatgaaagtcttaattaaatctgaaatcctacttcccagacctgaagtttccaatatcattttttattctcgcccaacatcctctgtgattaaaatagaacataagtggtgaaatcgctgattatttaaaggatagcatcatagaaacaaacccaaagcacgtagaagtcattttagactcatgaaaggtagaagatgaaagaggcttgcacagcatcttcatctcaggaagacttttgggtcaggttctgttcatttcattatcgtcactcttctcggttgcataattggaagttctctaaaataactacttctgacaaaatttctaaaagttgctgagtggaggcttaaaaaaggactaatatccttaatgatttgataaagattaaaatcacagtttcaggaagggttactttttgcctacttcacagacattcaccctcttctctggtagcctggacagtcattttctagaaccatcttccttctttattctgccatttggctgaatgacccttaaggtgacacaaagtaaagggactatgacaaggttaacaaatgtgcaacacaagttgcctgttctctgttgtttcgatgaagcattcagctcaatataaaaaactatatctcattaatacaccttccaactgggcagaggatgggagcacagaggggtccacagctgtaagtggaggcaaacatatgccatgaaacccaggccagtgaggaagggggtgacatgtggattttaatagttaatttttgttgttgttgttgtttgttgttgttgttttgttttgttttttgagacggagtctcgctctgtcacccaggctggagtgcagtggtgtgatcttggctcactgcaacctccacttcccaggttcaagtgatgcttctgcctcagcctcccaagtagctgggattacaggcgcacgccaccacacctggctaatttttgtatctttagtagagatggggtttcaccatgtcggccaggcttgtctcgaactcctgacctcaggtgatccacctgccttggcctcccaaaatgctgggattacaggcatgagccaacacactcggccaatttcttttttgatgtccaggtacagagaagttgacattttcatttaaacacatacttgacccaaggacacaattcctttaatacggctgggtatgctaagctatggatcatcagtgccacagtaaaaatggacttgtgtttataggttgtctcctggagattgttgtgaattatatgcattttaggaaataataaacttgtaatatgttcgcctgtgtgacttaacgccgtgtcagctagagtaagtgtgcagcacatccaaaccggaccttctatggctttaatacttctgaagacctctgtaaagattcttccttctcagtacccaagtgctgaaaaaaaacatgtattattataggtcagaattagcattttagtcagttattctagaagtagagtaaaaaacaaattttcagactcacttatgtatttttcacatgggtaatcctttgagtcaggaaactggctagagttacattccataaataaaatgttttgatgatgatgccaacttgggcatggccttgtctcttaacttaggaggaggacaggcagacctggggggtgatgattaagtaaaatatcagtcagacagatgaaccgtaggacaaaaccaccaccaagggctgtggggatggagatgagaccctggtcacctcccctggagaatgtggagaagacttcaccctatggttgatggacatgtggtctggggctggaaggttcagtgggattttaggaaggggagaaggaagcaggaacaggggaaacagtttgatctgagacactggtgtaaggttgggataattttcagtgacatggggaggaacacggccttgaagggtgggagagtggtcttccattcatgacttactgagcctgtcatatgtgtgatgcagtggaatccacagaggattctgtcctggatcacacgcaaacccagccttcatggagcttgtgtgtggtatggcgtgctaagtcgtagacccattacttaaaatgactgtgttgttaaatgtcaaccgagtatcatggagacattcatgatgggggactactgtggtctagatcagcggtgtccactaaagacatttgaagacgggctgggggcctgtggtctgacccaggccaggaagatgtgtagttcagagtgagttgggtatcactgctctgccttgaacaggtgcaccctggtgttatgggactatcaggttcaactgcccgttgcatggtaacagaccaccagtacaccaaaacagcaggatgtggagcagacaatgtgtttaataatcatagggcagctgaacaaggagacaggaggaaacctcaaatccgcctctctgaggagctttacatgggtgtttttaagggaattttggttagggggcttaggagctggagatcactgactggacagtgtgtgggaaatgaaatcataaggatgtagaaattgcactcctgcgctgaggctgttcctcggagggcattttcagatgggctggagtcagtgggcccattggactgtaggttctggaaaatatctccaaatggaaaatttgaggtttcttaacatttaaggtgttacctagagaagttaggagcatgtgacgggggcacgtgacttctaagcagcaagcagctatcagaaagtgggccaaaggacaagctggttaatgcgtcactgtgcttctacttaaagcttatgcttttgttaaaaatttagcaatttggttttattaattttatgaggacggtttccctggtgagcatttggctccacagagagggatccaacagctaagagtctgcagtagaggcgggatcccacagcttcactgatcaccccattttcctgtggccccaccaccatctcttctcttctcccaggaccctagctcgggtggaaacagtggggaggccttggtctccagctcagaacccaggagccaaaaatagcagctgagtgtaaattttcattaagacaggggattagagatcaaaaggggtggcctcccactctccagaccccaactcctccctgagtcagcacccccacctgcacctgcacctggagggaccctgcctgcccacactcggtggtggccacagcctgcatctagcagggtgtaccctgtgccaggtggcaggagagcctggaatgtgctgtcagttctcagctgatctacaagggtaaccacagtcaaagccattttaaggaggggaaagttaagtaaggaagaggccaattaatgtgcccatgaggatgttaacaagcagccttggaattggagccaagacaggactccagagcctgcatggggggcctctgggtgtatcatctttgctccagctgagcaccggcttgtctcaagaacaggctactgcatggcacctctgctcccctggggtcctggaaaggttccctggtctggggcatctgctcccagccctctggaaggtgggagtgaggatgatgacatcccagcagggcactggccgaccagcctgctcctatagcaatgccttcctgtcctcctgcccactgcccctttgggcactgctggtggccagcactggcggccagtgctggcctcttctccctgctgcagagctgcttccataggcggacctggtcagagctcaagtggaggggaagcaaaccttttggagtgtcttgggttacctccttaaacattaaagacaaggccgggcacggtggctcacgcctgtaatcccagcactttgggaggccgaggtgggcagatcatgaggtcaggagatcgagaccatcctggctaacacagtgagacatcatctctactaaaaatacaaaaaattagccaggagtggtggtgggcgcctgtggtcccagctactcaggaggctgaggcaggagaatggccagaacccgggaggcggagcttgcagtgagccgagatcatgccactgcactccagcctgggcaacagagtgagactctgtctcaaaaaaaataaaaattaaaataaaaattaaagacaaattaaaaatttgtccttaaaaatgcagggacatggatgaagctggaagccatcattctcagcaaactaaaacaggaacagaaaaccaaagactacatgttctcactcataagtgaaagttgaacagtgagaacacatggacacagggaggggaacatcatacactggggcctattggggggtgtggggtaaggggagggagaacattaggacaagtacctcatgcatgtggggcttaaaacctagatgatgggttgacaggtgcagcaaaccaccgtggcatgtgtatacctatgtaacaaacctgcacgttcttcacatggatcccagaacttcagtaaatttttttttagatgcagatgtttatgcactgacttaaatatttaataaggcatgctttaatttgtttgtttttacttattgttttaaaagctagagtcctgaccaatttgcttctgcctccacacattttgtttttagagatataaactacaagtatatctcagcaatatgaggccaggaaagagatgctccgagcatgctctgtagccgtggcccctgggccagcagcatcagtgctacctgtaggcttcagacctgcagaatcctagggcccagcccagatgcactgaatcagacctgtattttaacaggtcccctgggtgacctgtaaccacattccactttgtgaagttctgtttaaagaagcaggcctgggatttgcttactattcagtgaaactttcaataaagcttcttttctcttcctccgtgaacggcagttattttctcgtagcaagagtctggactacagttgttctgaatcttttgagtagatattgaaggggagatacatgagcatgcaagcagacgtgcccagtatagcgagaaccagaataatgaacccctgcaaagtgggagggcatttggaaagagtgcacgctgagttcatccccagcataaaggaaccagcccgttattctaatctgatgagggaattcttcctgacaattgagtgatggaaggaggcattttaaatctttccatgtgtgtctcttctggcaagtggacagggcttgtgatgaatcctaggtctgataccagggtctttaatgtaaaagacaaaaacatactagacatctagcctattaaacttgaactccagccaaataagagctgatttcctgctgcaaatcaacaaaagacctcctgcacatggaagacgactctgacactaacactgatttagggccaggaagcctgcagtttaaattaagctggaggatactagctttatatgaaaatggcaggcaagtgtctgtggctcacagaacaagtatgatatacttttgttgcaagacctttgcatagaaaatcatcttcttttagaaaataaattccgttgccaagttttgtttcccattctactctgccccttaatgtccaaggagaattctccctgaagtccttgaggatggggcttattcagcacatcatagatttatgaagcctttgccatgtgtcaagcactgtgctaagcccaggggattaagagcaacaggcaagccacagtctccctctgtgcaccagccctggctccgtgaaatcaggaaagcaggaggaaagaactcaaagtgcacgcctggggaagtatcactgccacctaaacccttcttctcagctatcttccctatccaaccactagacacactggtgtttctagtcgtctcaacttgctctctttctatgagttccacaattctcagtctagtaataatagccaacatttcttgaatattgtcatgtgtcatgtgataagcccagtgtggtgttttatatgcattttaccatttaatacaatggccgtataggaggcactatctttaccctattttattgatgagatattagggactgggacagacactcctcatcctgagcctaagccactgcaacagcttgtaaactttcccttccaattccaagctactcctttccagtatatcctgcaaatggcttccctattaatattcctaaattatgatttcgctgggtgtcttttctcttcccaaagataaacactattttgacaccttcaccatccattcggtttggcttgctttggaaccctgtataaatagaatcatgcaatacatattcgtttgcatctagcttaatttgcctaagattatgtctgaaagtcgcctcacatgtagtactggttcactcttcgcatttctgtaaagtgttttgttttaggaatgtagcaccatttattccttctgctgttggtggatgttcatattgcttccagacttgatcattatgcacaatgctgcgggcactcttgtatgttcagtgcataagtgcatgcgtttatattgatggttgtgagctatgaacatgttcagctttggttgattctgccagagatttccagagtagttgcaccaatttatactcccatcagcagtgaaccagaatgtcattttctttacattctctcctcacctgcccttgggaggggtgaggctgttttggtggtggtggtgtttttaccattctggtaggatcccattgtcattttgatttccatttcttaggtgacttgagcacctttttagatgctattggccatttgggtagcctccttagtcaagtacctattcaagttttttgctcatttttaaattgtattttatttgctcattttgtattatgttgttattgtatggctcccttatacttgaactacaaaagttatttatatattctaggtatgagaccttcatcagatacattattgcaaatatcctttctctgtagttggccttttcatataatatttttcacaatggtgtcttttgatgaacagaattttacaattttgatgaagtctaatttgttaatctttgcttttttagagttttaatgaaatatctagtgttattcaagatcatgaaaatgtttctgttatttgctagaagctttattattttaccttcaacatttagatctatgatgatccagaatatctttttgagtatggtgtgaggtaggggtcatgattcatttatttgtatatgaatattgagttcttacagccccatacagtgaagacaccatgctttcccccacattactgctgtgaaacatttgtgagaaatcaggtgacaggtggatctagttttggactttctatctgttcccctggtttgtttacccctggagagaaatcacaatatgtaagttactatatcttgttaactggtagtttaagtggtttagatatcatctttaagattatctttattattctttgccctttacgttttcattaaaattttagaatcggcttgtcaaattacacacacatactcactcacatagtggttgagattgcattctatgaaagattaaattagtaagaatttacatatttacattataaaattttccaatccatgaatgtgatgtactcctccatttgtttagatcatctttaatttctcttaacctcattttaatgttttctatgtaaggtcttgcttatttttatgaggttcattcctaagtgtttgagggttggtgaggctaatataaatgttttattattttatttccattttctgttttttctatttaatttctattctgttcattttctgtgtgtttatatgagtgaaatggaaatacaattaacactaattttatattgactttgcattttcttagtccttacttaaaacttggcattttattttatacagttttgtaattttatttggatgtttatttttcctgttctcacagtacttagcccaatgttgaccaaataaatacttaagtacttgtggatttgttgattaatgatttatttaaataacttttgtcctagctgggttaccttaaaagttctaacttggtctggcacagtggcccttgcctgtaatcccagcactttgggaggctgaggtgggaggatggcttgaggccaggagtttgaggttgtagtgagctgtgattgtaccactgcactccagcctggacaacatagcaagaccttatcccccaacccccccaccaaaaaaaaaattctaacttattatatcaatcttttcaatagtcagacaattctatctaagaagttaaatgtaactgaattccatgggcttctcaatcatttcaaaaattacaacttttaaaacaaaataataattccggaagtagatatacacattttcctgcaaatgtttctgtactatgtcacatcttgctgaaggtcattttagttaaattaatgtaaaatgcagactgcatgaaataaagaataaaaagaacaaaagaatagcaaatagaaagaattaaaaaaacatgggaaggcaattagcgaattttgttgaaatttgacactacttaattagcagctcaaatttcctgaagcttgaggctttaccatctagacaatattacattgaattttgggggtttaaaaatataattaaaagtttattggacaaaagttttacccacacctagcacatcatagacaacactattgataaaatgaaattaagctactgtatttgattatcctcataatatattttaaatgaaccatgaacaatgaatagctgacctatagtaaaagcaagaggttaaagtaaaaagaaatgtatctaaaatgaaaaaacatacacagtagttttctttgattttaaaccaaacatggatatgcctgtttcattaatgcattatctttagaaagtaatgtggggcttttttttttttttttgcaattgaaaataagattcatttaatcagctatcgtagttcatctgttaaattacagcactttgctgtccattttgtaaaataatcttcaaactaatgaagtaaggtcaattgcatgcaattttattctagccaaattgctgttaattgcatcaacggctttggtaaggtcaataaatgttgcctttttacatcctctcctgaaaatggcagaaaataaacaccttttctctgtaatgtattcaggctcgaggcaactcatagcaggtggactattcgattttcattacctgatttgaaaatgttccatttctaaagaattgtgggaggtattggagtcaccaaagcacttttagcaaagatatcttttagctgggcctggtggctcatgcctgtaatccaacactttgggaggctgaggtgggtggatcacctgaggtcaggagtttgagaccagcctggccaacatggtgaaaccccatatctactaaaaatacaaaaattagctgggcccgatggcacatgcctgtaatcccaactactcgggaggctgaggcaggagaatcacctgaacccgggaggcagaggttgcagtgagctgagattgcaccattgtactccagcctgggtgacaagacaatgtgaaacttcgtctcaaaaaaaaaaaaaagaaaagaaaagaaatctttctcggaagtgctcccttgttactcttgaattatgtcagtggtgtccctcaaatagagacaaacttatactgaacaactcagagtagattgtggaccttgacttgttaagattttaatttttatgataatcagtctagagcagatcatctgttctcctttaacctgtcttacaacaaacagtaaatgtttgtatgtcagctcaaccatagttatactgtgaggtataccagttggctcacctgctcagccgtgcagcctaggtcagtgtaaggaggggatatattacctggacccatggagggttaggacctcgctgtggccttattcctgctgcagacctgacccagtctttaggacttgatcacatctttacaagctttatgctttaagatatgcttttctaaccatctcaatttgtaaactgtgaacactctgtggtttctgaaatggcggagatgtgtctgaaaggtgtcatgtgcgccgtattacaaagaaaccctaaaaacagcaacaagtgagagatacaggtggaagtaagagcagtggctggaggcagagagagactgtggcaagcggatggcactcgacgtgtgggggcagttccctaggacctctgggagagttgcacttatcctattttccttgccttcacataaggtcacaatcactattagagtctgtttgatatactcattactaatattgattttacagttcaagaaacaatatttcttcttttgttttgagatgaagtctagctctgtcacccaggctggaatgcaatgacgtgatctcagctcactgcaacctctgcctcccaggttcaagcaattctcctgcctcagcctcccaagtggctgggattacaggcagccaccaccatgcccggctaatttttgggtttttagtagagatgaggtttccctatgctgaccaggctggtctcgaactcctgacctcaggtgatccacctgcctcggcctcccaaagtgctgggattacaggcgtgagacactgcgcctggccaagaaacaatattcttcttttaaaactgaatgagcagaaatactgttagtagccagctgaattcaggaaatgtgatgcatgtgctggtgcacatacccaagaagactgaagacagcatagaaggacagaacaaaaggccagtgccaagggtggcagagggagtccttggtgcactctgggacaagccccctgcgtgctgggtgtttcgggtggtctgtctccatgtgcaatatcagtcatgtgaagccttaacaaggcattcatttagttagtatttcagatttgccaaccctgttggtgttgggataagggttagagatacagagaagcacccctgccccggaggagatcactgcctggtgagaaaaccaggatgggcttctactcaccccttcaagtccttgatgaaaggttccttctgcaggagcccccagcccctgccttctgctgtgtcctgctcctcctcacctatgctcctggcccctcttcccctgccttattctttatggcaccattgcctttccagcttagtttcagtggcttgctcattttcatttctcctcactatcacacaagctcccagagagcaggaggtcttgtcattttttgttcatttgtttccaccaagatacttagaacaatgtctggcatggtgagccctcaaaagtatttatggagggaatgaatgaactcgtgaataaatgaatgtatgaagtactaatagatgggtgagcatggaactctatgtgatcaagtgtaaaaggcactttcccaaacacaggacttaatgagaggcagtcagatagtcaaacactacagcacttgagttagagaaacgttttgactaatcaaggaagcctttctgggaagtataaatgtctgcattagaactagaaagtctagaacgccgtaggaaggtacagaggacaagaacgatctccttgggcaggcagaaatgatcgagctgcgagctgccggaggaccgcatgcaggggaaattttgcttttctgagtgctgcttggctttgagatgtaagatttagacgttagacactttctagctcattttactatgccagtagtgatcctccctttcttatttctttaagaattgaagctggcatgaatctgttttcaagctgccatttagaagttggaatagtgtgttatattaactttatttattcttaaaatatcatcttggtgcccaggatgacactgcctgaggagctatcaaagagccaatccctgtgggatttgtgagaaaattcagccatctctagacctccaattccaaacctctttcatctcccaagactctatactttgatctaacctcttgagtgacttccttcaatttcttcctttcacagcaacaatttcagtcccagggcatacacttatacttataaactatttctggggccagcttgacctcaaacccgtacaagatgatcgttccagacagagaaattctcaggacatgaaaactttcttagaatgtgctgaaatagggttgtgaatgcgtgtgttgctacctctgaaaacttgatttagtgctgtccagcaaaagtcttgacatcctatgttagttggctcagctctatacaaagaatctgaaagcacggtagaagatggttggcttgtgttaggttagaaaggcgtaacaatgagttgttttctaagtgaccagcatgtgtgatttatgactgtattccagaaaaattcaattatatgagataaataagtacagagttagtatggggcttcagaataacaggaagcagcataaatattgccctcgcccaccagaattcatcactgatggcctgctctggccctgccttctgctgtgcatggaatttttattgagcttgatgagattctgtgtaataagatgctggattccgggggctaatggcctacgagaagatttgagtgttgagattctgtataatcagatgctgaactccatgggccagtggcctattgagaagatccgtataataagatgctggattctgtgggccagtggcctatgagaagatttcagcattgagattctgtatagtaaggtgctggattctgtgggccagtgggctatgagaagatttgagcgttgagattctgtataataagatgctggattccgtaggccagtggcctatgagaagatctgagtgtgcctactggatagttacctgctggaatgcaagttgtcactgcaagattgatttctagtgacaataacaagcagaagctgactaacagcacactgcccaccatctgctcaagatacccaataaagtgtatttgttcctcattttctcggaaaagtctccacctgaaggtcacagtgagatagaccaccacagtgaaaggacatttgaggtttcttcctgcctgcactggtgatgacatcaggaaacttgtgaaaccacggtcttttgtttacattagaaaatgcatgtgagatgacaggtcaacatcagcaaggcataacttaacagagataaaggtaatgctttctgttggttagaaaaagcaaaagttttgaaaaacacctgagcaaagaaatcttgagaataattgctagccaaaaaaaaaaaaaaaaaaaaagaattggggtcatagggaccaacattgagacactgttgttgaagcagcaatgaataggtattttgtccaaataaaaggacgtaatttaatcattgttaatgtattgcccatcattggtaagccctcgggcatacacttacacttataaacttatttaatccacacatagcattatgaaggaggcattatcatccctgccttacagatggagaattggagtagaagaagtagtaggtaacttgcccaaagtcatagagggtatcgacttatcgactgcactgctgagtttagggtctgcagtttgtctgccatgatggctcacatctggagtgtcaggttcagccctagaagccacgttgtctggtggtgaacactgaccatcttgcagtcactgggtccacaagaggggaaccactgtgagaaggtgtcctgtgaccaacattgttgaggagtatctaaagggtgaattcagggaggttgtgctacagccttaaaaacacataaagtaactcagcgtcatcctttcttgttcacactggaagaactgaagtcaatagctggtcctagggagatgaataccaatatgagagatgcaggctgcacagacctggaaacagcttctgtggcttcgctcaggaaagaagccagacagccttctctcagggctcctgcaagtgggattcctgccctgcgggttcccaggtgaacacaaaagtcagttccaactctaaaattatttgtcattcggtacaacaaagataccactgcctccctagcaatagagttttttgtttgttttttgctttttgagacggagtttcaccctgttgcccagactggaatgcagtggcaccatcttggctcaccacaacgtctgcttcctgggttcaagcgattctcctgcctcagcatcctgagtagctgggattacaggtgtgctttatgatgccatgctattttttttttttttttgcatttttagtagagatggggttttgccatgttggccaggctggtcttgaactcctgacctcaagtgatccacccacctcagcctcccaaagtgctgagattataggtatgagccaccatgcctggccgcaatagagttttaaatccttctagaaggtactccctgagccaaccttgcactctctttgcaccccatggttattctgatgaggcagccattcaaggccacctgggctggaggcctggctgctccgagtgcagccctgctccactacatcagcatcaactggagcttgtttggagtggagactcttcgtccctgcaccaaccatcactgcagttttgcagggtctcagatggttcccgtgcacatgaaggttggattcccacatgaaaggctgtcatcataacccacctggaggagctttcagaagactatggtctaggtccttcctcctcccctccacccattgttcttggtgagccctaggcattgccagtgagggtttccaaagctctcccagtggctacagtggcagccagcattgagatgccctggtataaggccacagaagccagccacagtgaccagccctcctgagggttggccatgaactgatctctagggctctgttgagccttttgaacattgtttagagtaagaggaaatgtagttgttataagaaatgctcaatgttccagaagtgctatgagttactagaacaggaattttcaatggcagttttattccagtttgtccccagtgcttcaagagagggttgggtagggctttatgtgtttggggaagttgctgaagaaagcagctgaataactgaatccttttacttataaaaaggttcaaagttgtccagctgaaatgctgaggttgggagccttcaaattgaggacctcagggttctccaaacagaaggcttgcaagttccaggctgaggctaggggagctgtctgtgtctgtggcccccatgggtgattggtcccctctgtctgagcacgtgcgcggaaaaccatgctccgtgggttgacagctggtggtttgcttatttgcttgttttgaaaatgtctattttttaagactctattgtagctgaatttaatataaatgctttcatttgaacatttggccatctttctttagctaacatgtgctcttatttttatttagcctatttttaaccattgagttactacaaaacattatctcaggtttattttcatctgttacatgttttaaactgtagccatctgtgtctgaaacatttttatctgctacaagttaatattttaaaatgttattaattgggtaattatttagctgtcttcaaaaaacaaaaacaaaacagcaatcctgcttttccagctagtgagcagaaagtcagggcggtggggagtgtgttgtctgtccagccctttgcttgggacgggagtggtctcttgtgcttccgtgccctggtcttacctcaaagttactttcttaccttgaagacccaccattaaatataaactaatcagcctatataaacacaaatataaccagtaaaaacaaacaaatcaaactcatcataagtataagcttttagaaaagactgttgtcccaactttgacaaaaaagtggcatagtacatcatttgaaattcaccatactcacatggatgatgtcaccatccccgccctcagactcattgtccatctgttaggaagaggtgcacccaccacaggcagagcacagctacaggcccacacacacttatgccgcactggagaaaccgacctgccagcccagctcatctccttgtttcttgaattacccagttcatgtatgagaacaagaggaatgtgatctgaaactccccagttaacaagctgtaaaactgcttgacgcctgccaggctgtgcgaacaaaccaaggggcaggaggtgagggcaggggcggtggggtggggggttgcattctggaagagtcccagggtttcctctgcatcccttcggtgagcttagtcgcagtaccttagtcacagccaggtagctgccgttctcccattcccaaaggacaaatgtactaggatttgttaaaaagggaaaaatcctctgcatctagaaccaaatacctctctcatctcttccctgatgggagtaatcattctgcacctcgagattgacttgatgtcttaacttttgcattggatgatgttacctatgttgggagttacatcggaaccggcacagtagttgtcaacttcagctacatgggaaaattcatggaagaagcttgaaaaaatgtaggcacccagctgacattcattattgaatgaagtcataggataagcttctttctattagatttttgccccagcactcagatgacctccacaatctacagacaacccagagaagtgggagggttctatcagtgagttacaccgggcttataccaccaaataactggctcaactggactcagaaaatgggctgttcatttgacttggtgtcaggctgaaaggaagcagcttcatccaccattatgtcaagacatagacgagttcagaaattcattgcaccgtaggttattgttgagccacatggaattaaagggcttgcccaaagcagatacttctctggattttgccaagctaggcagtcacacttcccccaaaaagaaaagtagaaattagacaaaaataaactttatagcactagaaccaattttaatgaaccacaatcatgatacggatttagtagagaccataaaatccacaggacaaggtgcgatctccacttgcctttggtcaaagctgagaaacaaagaaccggaagagctcactccattgtgtcctgttttctatggagagatgagccccccttcttctcttcctgtgaaccagcttgaatcggaggggaacgtgtaactatgaggttcagatcacactggaacacagcgtggtccatttatgctcagagtccgccaggtggcatggacttcagacagcacagataccctaattaccatgcctggtcttgcggttcacattcaccgtccttcttaaaagtggggaagggggccaggcgcggtggctcatgcctgtaatcccagtactttgggaggccgaggcgggcggatcacaaggtcaggagatcgagaccatcctgactaacacgccacggtgaaaccccgtctctactaaaaataccaaaaattagccacacgtggtggcggacgcctgtagtcccagctactcgggaggctgaagcaggagaatggcgtgaacctgggaggcggagcttgcagtgagccgagatcgcgccactgcgttccagcctgggcgacagagcgagactccgtctcaaaaaaaaaaaaaaaaaaaaaagtggggaaggggaaagggagccttgtctctatcttccggggtaagcctgcgctgctgggctcctgacaggttccatagactcctcttgcagcacctggggtgctatcttgtcacagcttataacctgctccagagcctggctctgagcaaaattgctgaggctgaaaaaagacagtaatgcaactcaggctgctagggtgttctcactgacaggactgcagattctgtttggctgaccacaagttacaaagatgaagacaaagtgcgagcaattcaagggccagcttgactagctggtaaaacgagtggcaaatgtactaggatttattaaaaagcggggaaaaagattccctgcatctacaaccaaatacccctcccatctcttccctgaagagaaatgattctgtaccttgaggttgaccggatgccttaacttttgcactggatgatgttacatatgttgggagttacttcagaatcggcacagtggttctcagcttccgctgcacgggaacgttcatggaaagaaatttaaaaaatgcaggtgcctagcttgcaactgcagagattctgacttcactggtccgcggcaggattcctgctcttagatttaggtaatctgagagttccccccaagtgattgcagtgtacaaccatggtaggcaccgctgcttaggttgaatgacatcagcagaatgttttaaatcaacaggtttcatgagtttgagatggaagaattgggtgaggtagaacccattaaaatagttaaatgggataaaaaaaatcagaaagttgaaacaatgaaaggcagatgtgactttgtaatcatcaggacatttagatttgcccaagtcccaatacaattccctccctgtgaagccttagaaattcctcagaactgtctttagtaatagaggcatgcaatatgattggcagatgaatttacagggaggagtttgagcacgcatggaaaacgttctgattttgttgtctttgagatgctcttcgatgtcacagaaggaaatgtatgattagtgtcggtgttcttgtcaagagatggctctcttcctttcttaggggaggaggcaacgacgagctttccatgtcccattggagttgttgagagacagggactgacaagatcaataattgtttccaaataatggggcgcattagcagcttcccagggtcatgctaaggtgacaggtgggggcagatgtggacagagacccggaaggatcctaactaaaagggaactcattatgtgtgatggtccccttgccagccataggagacatttctactagccttggttaacctggagccacagtgtgatggcaacaggcgctaggccatgttttgagttagtgtaatttcaaagtgtacagtttaccaaatttgaacttttttttaaattttattttttctagtctggcttttgcaagtgactctgacaaaatatttctgcattcaaatatctggcatttctataacaatttgagaagcttggccttataagaaaatctccaccaacacctggtgtatgttcatgtgctttataaatattaatttcattgaattgaaaagccaaaagtctgtttttatgatataggtttgttttcttgacttttctccaaaattattactagagtctcattttttaaaaagtctgacaggaacatacccaacatatatttttaagtaatacagcagaagaggaaacaattagaaatcagagtgtgtagcatgagtaagtgtaaatataatttcctgaaatcttcatttcaattgtgtgtgtatgcaattagattgtaaaatttattattgattgattgattgattgatttttgagacggagtctcgcactgttgtccaggcgacagtgggcgcgatctcggctcactgcaacctccgcctcccgggttcaagcgattctcctgcctcagcctcctgagtagctgtgattacaggcacctgccaccacgcccaactgattttttgtatttttagtagagacagggttttaccatgttggccaggctggtctcgaactcctgaccttgtgattcacctgcctcggcttcccaaagtgctgggaaggcatgagccaccacacccagccgtgaaatttactttatactgtggaatgtaagtgaaattctgaaagctattggataatggcgttgtttagaataataaccttatagcgtaaaccacaaacatgaagtcagccgactactgcgatgtatgccaagcacaggaatctggagaagtacgagcctcctggctccccactggactttttattggggtgctagaccagtggttctcaaagtgtgctccccggggcagcagcatcagcctcacttgggaaattcctagaaatgcagattctcaggcatcctatcccaagcccaccgaatcattatctctgggggtgaggctcagcaatctatgttttaacccttttcctgtttgctttgagaatgttctctggcagcgcttgcggctgcagtgtttactccggataattttgccacgaaacatctcacttttgttactgtttttgcattgttctagcatatcgtctttggaaacaaaagacatcattctatttacagcattctggttttagtagttgtatttccatttacaaaacatagtaattctcgatcgctgaaaatgtcaaatcctagaaaacgtagcattcctacgcatgatgttaacatcgttcgcaacagttgttgaccaaagattcattagatgaattaaattttcccaaagtagatgattctgatgttagtaacaagaacagtttttatatttcactttcaaattgaaaatcagatttgcttcagcttcaaagagcatgttaatataaaattaaatgagcattgacggcaagctgcatttttttcctaaacaggaaaagggttgagcctcgcaggtggttctcttctgatatgtggcctctgagagaatacctggccagccaggtatgaaggtggaccatgacctccctgtctcagctccaggcctgcgcaatatccatcaatcccataggcatttaggcctagaagctaatcatgatgggtgtttcttttgtttgttcattcgttcgttcgtttgtttttgagatggagtctcactctgtcacccagacgggagtgcaatggcccgatctctgcccactgaaacctccaactctgggttcaagtgattctcctgcctcagcctcccaaatagctgggattaaagacacgcaccaccacgcccagctagtttttgtatttttagtagagatgaggtttcaccatactgatcaggctggcagtgttttcttctttacttctgttgctgaagtttgtaactaactttgtgtcaactgtttatttatttatttttgagacagagttttgctattgtcacccaggctggagtgaaatggcatgatcttggctcactgcaaccttccgcctcctgggttcaagcgattctccagcctcagcctcctgagtagctgggattacaggcacccaccaccacgcccggctaatttttgtattagtagaggtggggtttctccatgttggccaggctggtctcaaactcctgacctctggggatccacctgccttggcctcccaaagtgctgggattacaggcgtgagccaccacacccagcctcaactgttacttgatcaacccttaacagaatgtggaagttagtgaattgctaacgctgcccttggcctgctatttcccagctggcctctctgtgcccagcccagctctgagctgccacatgtcccctgcctttcaaagaatccaccttctggcctgacttttctagctaaattttacaaaccataattcctagctttcctattttctcagaaaaatgtccaccaggtgtttattcaggtgtctcattgttataatccaataaataaacacatcatattcatgggatagcagatatatgcatttatttatttatttatttatttatttatttatttagatagagtctcactctgtcacccaggctggagtgcaatagcacaatcttggctcactgcaacctccgcctcttgggttcaagccattctcctgcctcatcctccctagtagctgggattacaggaacccaccatcatgcccagctaatttttgtattttttgtagagacagggtttcgccatgttggccaggctggtcttgaacccctgacctcaggtgatctgcctgcctcggcctcccaaattgctaggattataggcatgagccaccacgctgggctggatatatgcatttaatagggactctttgatgcctgagggctcatgttatcaattgtgaatacaagacaggcctatgggaggggtgtttattttttgggggggaggggggatgggcagctggatgggagttgagagtggtctcatgttcatcaaatcagcccaagtagatgattgatttctctgcctcagtcagattttgtgacaaggtaaagcagtagattcttgagtagttgataaatgatattacaatcttttctaaatttaaactcttcgttgatctttgtcctgtttgtataacctttatcttttttgaaaaatgttagttcagcaactgtttagtttaattagctgattcattaaacttgggtggtggctcaccaataaaaaagcatttgaatgtttgaatgtcactcagagctcttcaatttctttgcagaaatactcaacctagattcttttaaattctctacctcagaacctgatagaatacttgcatatttttactgatgatgtttcacctatacttaatgtaataagtaaacacactacacgagaagtcattctgtaggaaagtgagtgcggatttctaattacttaggcacagctagtttcctagcctgacaggtgtggaaacacctttcacactcgaagcatgcagaggcttgcatgagctcacctgagcattctgaggagcctccctatgcagttttggaaccctctgtttgattcaaaggtctgctcctgataccagggaggttttagctttctgccaaaagaaatgctctttcatcttcaaatcaaatgttgaagtgggccgggcatggtggttcacacctgttatcccagcactttgggaggctgaggtgggcggatcgcttgaggttaggagtttaagaccagcctggccaacatggcaaaaccctgtgtctactaaaaagtacaaaaattagccaggcatggtggcaggcacctataatcccagctactcgggaggctgaggcagaagaatcacttgaacctgggaggcagaggttgcagtgagccgagattgtgccactgcactccagcctgggagacagagtgaaactctgtctcaaaaaaaaaaaaaaaaaaaaaaaaaagaaagaaagaaagaaagacagaaaaaacaaacaaaaaaatgttgcagtgaaaaaatatcacctcctcctactctcaggatggtacttctgcccattctcctgagtaggctcaagcttctgaaaggagagaaagtgggagtggttgatatttcgtgactctcactggcgaaggcccacttgcagactggccctgcatcccgctgtcctgaatgcacacgtctgtgtgccgtgggatggcctctagagcgattcctccctgaatccctgcaacagacacctctgagtccaggcacagcaggatttcaggaaccagggaggagctggccaggtgtacacccgggcagatacctgtgacccgtgatttcaggggtgacagaaaatgcctcttttccaaacaccaagcaaaggaaccaaaaccaaatctacacaaacatgacctttccctgtaactctcctgattgctttcatcctgtgctttgaaacagggaaaatgcgtagacataccgggaagccagaggggccgtcgtcctggttttatgatgcgggcaggaggaagttatcaagggccgtccctgaaaacaggctttatttggacagtgtgagggatgtaaagaggagaaaggcagaccccagagagaacaggtgccctagcagagatgagaccaccccccggggagtggggagagcctcaatcagagtcccttactggaggtttgctctggggcagccccagtggaggttgctgcctgctttcatgttgtcggatcacattctccaggcagaaatggtttggaggatcctgggatttgaaggctggtgctcgctaatcatggctatgcatgaagcgtaacacagggcggtttgagtcatcttcctcggggagttttgagaggaacctaggatgccttattaggaatgaggttattgcagagcatggattttctgaaagacaaggcaagcacatggccatctggtcagcactcaccgctccctcccctgccccaccatgagtcgcccccaacacgcagtgcctgtgctgaacacactgtgcctggccgtgcgtgggcagtcacttcctagcccagctcccagactggggtcgccctggatgacagcatcacccttgtgccttgttcatttacctattcagatatgaagtcaagatactgtgggtgtccagagatgcttttttaaaaattgcttcctggggaataaaaaggaatggccattaacacattagttgacatgctcaaaatttaatttgcaaacagaagccaaaagagacagctaaaacttttcattggaagcaattaaaataggaaagcaacgggactgaacagttgatagtttgccagtgcaggttctgctctgtgaggcacgtccaggaccccctgcatcagtgtaagtcggcatacaggggttagagtgcaccatcctgggaatgcatgacacataggtgtgcttggttacagaccagcttccccaccacccaggctgaggcctttgcagacagaaatcaaacctacctggattagcacagccctggggactgaccctggaaatggagttcgcgtctcttcccctcttggcctgtctttatcactcacagctcagttagtgcctctcggcatctccttcctgctgtcttgccctgcaccatccgcttcctctctcgttttctttcttcctcacattctttcatttaaaaaaaattccaagtatgagcaaaaaataattttaatgggatgaatacactcaattatggtcttagttgtgtgcttaaagggagtaaacttagaatgtgaagagccagaactagaaggttcacagtctgtgtagtctcttcctaattaattcatttttctgtaagggccagccttcaagaaaatgtagaaataacgatttaattctattttattctttttttatttgattaataattactcaattagatccccatgactttatgtaaggagaggccatggtgtttgcttcgtgaggcggttgtgaggagccatctctgtgaacgggctcctggccgctgaggtgcatttcacaggtgctcatgctagctccctcctcagtgtgggcttggccttgcaaatgggcacaatttgcactaaatgcagactcctatggattttgcaggtagattctagtttttctgaacaatttttgcatttatttctgcatgcgctcatttaaaaattgtgttgttgtagtagagcatgcatactaacattgaccatcttagccatttttcagtgcccagttcagtggcatgagggcatttacactgctgtgcaggcattttccaccatccatctccagggcttttccttatcccgaacggaaactgcgctaattcaacacgcgctccccattccctcctcccgcagcccctggcacccaccattcaactttctgtctgtgagtttgatgagtctaggaagctcatctcactggaatctgatggtatttgtcctttgtgcctggattattccgtgtagcataacatcctccaggttcatccataggttcatccttgttgtagcctgtgtcagaatttcctacccttttaaggtggtgagtgctaagttttaaactgattgccttataagccaaaatgttagaaaccagcctattttcacacaggaggctgtgcttccagaaatctgcctaaccctgtcacgttgctgtgtcacgccatcaggctcttaatgagagcacatgaagaaaccacagattttggagttagacagactccagttggaatcctagctccacaaccacctgctgggtgaccttggggacattatttcatgtttacgagattaggacaggaatagtaaatacctcatagtgttttgtggatcaaatgagctaaggtttaaaaagtgcttagctagcaagggggagaggtcagcttcctaagtgtctgccctcccctggagtgtggtatcatcactgtcactgttgcacgtgagccattttaaggaaaaggtgtgtttttcaggttatctttcctatgccaagagccataggagtgcattgacacgtgcagaccccgcaggaactgtgcattccccgatggcaaccgtgttcactcatgcttctgtctttcccctccacactttgagagaatgggctgacattataggttttttttttcttttctgtttattttttctttttctgttttttttctttttttctttttttttgagacgcagttttcctcttgttgcccaggctggagtgcaatggcaccatctcagctcactgcaacttccgactcctgggttcaagcgattctcctgcctcagcctcccaagtagctgggactacaggcgcctgccaccaggcccagctaatttttgtatttttagtagagatggggtttcaccatgttggccaggctggtctcgaactcctgaactcaggtgatctgcccgcctcagcctcccaaagtgctgggattacaggcgtgagccaccgcgcccggccgacattatagttttaattaattctttcaacaaatatctctaagtactcattatgtgacagacactttgaaggcgctgtattgaagcataggaacttggtcctgagcaaatgagggacttaatgagagcacatgggcttgcaaaccgtgaacccatctcagggactggaaggctctgacaaaagaggagcgtgagtcccggggaagagagggcagacagttctggatgtggagggtcaagaaacgcttttttgaggaggtgacatttgagcggaggctggcgtgaaatgggggagtggattatgaagagtgccaggggaaatattccaagcagagggaagagcaaattctagaacccttgagtggctatatgcctggcacaccccaagggcaggaggtcgaccacaatggcgaggggatgttggcccgggtggaggggtaggaaatggagtgaggcaggacccggaaaggcaccatggctgcagatttctatcagctgacctttattcactacggttttagtatgagccttgttacagatgaaatgttgtggaggtcctaacctccactgtgctagtatttggaagtgaattatttgggaggtgattagggtgagatgaggtcatgaaggcgtggccccatgatgggatcagtatccttataagaagaggaagagacgccagtgctttttctctgtctccatccaatgtacagactcagtgagaagggagccatccacaagccaggaagtgagctctctgcaggaacagaagctgccggcaccctgacttggacttccagcctcagaactgtgaaatgtctgttgtttaaactactcagccattggtatttcattatggcagctggagcagaccaacgcaagccttttattctccaaatgattctggtgacctctcaagacctttctctatgacgcccgccaactttgtaaataaatcctaccctttcatgaatggacgcagagtgaggaagagtcacttccttcacactcaggagcacatatactcacctgctggcccacctcgaggggcccagctaggtcagtgccaggagaggcaaggttggtgcatttcacattacccccactgaccccaccactggtagctgcctgggccccaccagccttcccggaaaccgtgtgcatttgcacttagccagacagcacacggtgagaggcttatttgctcatatggtactttcaagaatctgcagcattgggtaatttgctggccatgtggagattcccatgtgcggggaagggctgctgggctgaggacctgagcagatggtggtcattaatagcaccaacatgtgaccagctgtaattgtgctggaaggactgaagccactgatggttgctccgtactttggttctacttaaaaaatacttttagcaggacataattcattatacaaggcagcattagcaaagaaatatcagactcccagtaagtgccattttcctacccctgtgttttaacaagtattcctggtgtttagaaatacatagtctctcagtcatcgtgtgggtaaaagtgagaagagttgtttttctcagtggatcaagactaagtcttatgagatttgaaatctagaagctctgctaaaattgcatatagcaatgcctgtgaatatgtgaaccgaatgagaaacacatttgtgtcctagagcagaaacttagattcagctctttatacacacaatgacccctcctggttaattgacttgcaatggtagtttcaggtatccagcagtagttctggctacagcagatctgtctacccactgcctctaaagctaatctctccagttaatagcttgcagcctgggcctcattaagtcaaagaacttctgcccatacaataggctgtaatcctctgtattagtatgaggtaatttggctcctaactggggaatttttctcgtctaataagaggagaaattgtttggtacagtagaaatcatatagtttcccagcatttggctcttggagaaagtcagggattctgtatcctgttccttacctctggagggattcttaagttgttttgggtatcttacagcaaacacttttagtgacaaacaagtcaaattaataataataataaaaaacctaacagttgttgactactgcgtgcttaagaagagttctgagccattttcttgcatgaactcataatgcccacaacaactctctaaggcaggtattcttatccacatgttgcatacgaagaaactgaggcccagagtgattaagcttcatttaaaaagcgtgaaatggggcagtgagtcatgaacagtgccggaggaaatgttccaagaagagggaagagcaaattctagaatccttgagtggcaataagcctggcacatcccaagggcaggaagtggaccacaatggtgagaggatgttggcccacacagagcggtaggaaatggagtgaggcaggaccagtatcgtaccagtgctaagataaaagcccaagcagtctaatttggagtccagactcttgatcattgatatgatttggctctgtgtctccacccaaatctcatgttgaattgtaatccctagtgttccaggaaggaccaggttggaggtgattggatcatgagggcagtttccttcttgctgttctcctgatagtgaatgagttctcataagatctgatggttttaaagtgtgctgtttcccccttcgctctctctcaccctcctgcttcactgtggtaagacgtgccttgcttccccttcaccttccaccatgattgtaagtttcctgaggcctccccagccgtgtgaaacgtgagttaataaaatctcttctctttttaaataaattacccagcctcagttagctcttcatagcagtatgaaaatgggctgatacaatcactattcaatatagcttctaaaacatacatttgtattatagcatgctagaccaggctgtgtgagccacttgggcactgcatggatttgggtgagccggggaagatgtcaaccccactgtcagttgttatgcaaaggggagccttgtcttcatcctaagttgaaatcttagggactgtctcttctggacataatagaagtgtgtcctgtgtccataattgtaaataaacttactggcatatagaaacagtgcctggtgagctctttttgaggatagatgctaggtcttctctttcattctcaggacccagcacaatggtggggccactcaaatgtttttgaatgaatacatgccatttttttggaagctgtgagagtttatacatcatttttcacctattgccagacatttgctgtctccatatcttactctatacatgaaagcagaaagtagaataagccattgtatgatttcagagggagaagtgaggaaatgggaggtagctgtgtaaaattagatataaactaccatcaaaaagtaattgatttaaggccctcttaaaaacacattgtcttagctttggctgctatgacaaatgaccatagactggatagcttaaacatcaaaaagttgagaaaatttatttcatacaattctggtggatgggaagttcaagatcaaggtgcccacagacctggcactggagaggagggctcccttcctggtttgcagatggctgccttcttgttgtagccttacatgtcagaaagagagagagaagagaaaactctcctgtctcataaggacactaatctcattcatgaagcctctaccctcatgacccaattaccttttgtattagtctgttttcacactgtcataaagaactacctgagactggataatttttgaagaaaagaggtttagttgactcacagttccgcatggctggggaagcctcaggaaacttacaatcaaggcagaaggcaaaggagaaccaggcaacttcttcgcaaggaggcaggaaagagagcgagtgaggggaaactgccacacaattgtaaaccatcagatcttgtgaaaactcactcactatcacaagaacagcatgggggaaaccacttccatgatccaatcacctcccaccaagtccctccctcaacgtgtggggattacagttccagatgatatttgggtgggaacacagagccaaaacgattcacctctcaaaggctccacctcctactaacatcacattgggtgttatgatttaaacatatgaattttgttgggggacacaacattcagtccataacacatgtgttgataattacaactcggttccaagaggtgcctccataaaaggtcacagagaccccaagaacagagctgcctagagttctattgcagaactccagggttgcagcaattaattttacatctaaaatgttgctgtaagaatttaccccacaaaaattgatcaatgggatcacttggacacagggcagggaacatcacacaccagggcctgtcaggtggtggggggctgggggagggatagcattaggagaaatacctaatttaaatgatgagttgatgggtgcagcaaaccaacatggcacatgtatacatatgtatcaaacctgcacattgtgcacatgtaccctagaacttaaaagtataataattttttaaaaaaagaatttaccccacaaaaatgtgggagatgtaaagagaatagaaagcttgtctttacagaagaatgctccctaataaatatagaaagcattgtggatatagaaaagcatgattatgcaattcccaatatcataattgattaaaccaaaaattagtgaatgctaaaaattattgtcatagattattggggataagatatccatagaatattcatgtgtaatttcacagattcttattagtttaacatgaaaatattacctgtctaatggagaggtctagtggacacaacttaagccaatagccaaactaagcattgccaatattgggtcaaaatatgcgcttcctgatatgaagccatctgccacccaaaatgccacttatgtacaattactgcccaaaatgtttaagtgaatctaatcatgaggaaacaagcagagaaatccagatgtgggcccttctacaagataactggcctgattcttaacatcaaaacaaaattaaaaaacaatgtcatataagcaaaaagaaaccaaccaaaaagtaatgaggttgaggggagaatatactaaattgaaaaaacacacacaacattaaccttaattgtttcattgattaaaaaaatagatgcaaaagacattttgaaaaaattggggaatttgaattggggctgaacacctgtgttgaatgtattaggtgtggtaaaagaggggtaagagtagggttgtgttagaataaaagaaggtccacattgggaaacacacgctgaagtattttggggtggtgtttgcaaattattttcaaatggcttagcaaaaagagtgtgtgtgtacacacaaatgtgtacatatatgtgcatatagagggagagagtggaggcataattgtagtaaaatgctaacattggcgacatctacatgaagtgcagacaggtgttcattgtgttctccattcagcttctcctggaatttgcaattctttagcataggtagcatggggcaggtgggaggagatcatacctgtgcacaccaggtgaatcccagttgggaaacggcaggtgagtcctggggacatatgtgtctctgctagagcatccttctctttgctccagtgctatggggtgcagacgggggacatccattcatgcttttccttcttcacacattcccctggtacctttttgctggcagggaacacagtccagtgtctgggctgcagatccctcatggtcagaagaggggtttggtgagaagtgggagactggttgctagtcctgtgagtgcatgccagaggccatctccttggttcatccctgtttccccagttctgggcacaacttgcctgtgtttgccaggaatgcatagcttatctgagcttcctcatggggtgagtgggtgaggagagatggtgttatcatcaactgtcaaagctggaggcttccagaaatgacactgctgtccagggtggatggcagatgccatctggactgtctcatctcagtgtgcaggcctctagggacatcctgccctgggcgtggggcttctctgccatgagggggatcctggtgctgtgagtgtatcacaggtgatgtggcaaaggtgggcgtgggcaccagatacagacatttccagtgggatctcgttgtactttcatacatgtcactgccggactctgtggtcttaaaagccatgaagccagcccaaggacccttgccgctccatgccaggcagcctcctggccccgtctgactcgccttagggggtgccttttactccgttgtgtacaaagcattttgaaggaagagaaggaactaacagttagtgttgtcagtattctcagaattttggcaatatcccataataagaaatctgtttgatcaactcatatacacctacacatgtaatgcctctatatgggtctgtgtgtacatatcggtatgtatagctgtgtgagaggatctatagacatatgtgtgtatgtgtgtatacacatctataatgtatgacaaaagtttcatcagaccatccgtacgctcacactttgatgtttactaacatcaaagcattagtaaatcagtatttcttaatgcgctgcttgttactggtttaggctacttatgatccgaaaaatgctggtttcagcaacacggaaaacataaaaagataattatagaacagggttaggaaaccaattctgtctgatgtgtgtgtattattacatgagagtatttgtatgtatccatgtatgtgtctgcatgtgtgtgtatttccatttatctttgcaatggtgcagggcaactgtgggtctgctgccattgtgacttgtttctgtcctctcctgggccgggcccttcaaaaactgtggagggacatttgtcattggtgtccgagcttctgtgctatttctccagaggggtcatgggatgacacagagaggccctgtgctgcaggtaaatctggaggacagcttgcgcccagggaaattacatgcaaaccaggttttcctgtcctcttgagtggggcttttttctttcagaaacccccctttttttttcctttttttttttttttcaatgatctctgcagaagcagcagcatggggctcaaatttgaagtgagccgcagatgcaggtttgcttgcgagtgactccctctgctcaaaatcgtccgcattttttttcttcttctgagacagggtctcactctgtcacccaggctggagtgcagtgctgcaatcttggctcactgcagcctccacctcccaggttcaagcaattctgcttcagcctcccaagtagctgggaccacaagcttgcgccaccacagggcatcctgtatttcaagcttcccccttttgaaatgaggattgctgacggatggtgtgcaaactttagaacttgttgtcaagatgtcagttgaatcttaattaaccattgaggcagcctgggagatacgcctattctggtaggaatttttattctttcaagttcaaggatttgtccttcatcattttccaatccatgggatggtaacaataaaaatagctaatagctaacaaatgtttactctgtgctgcgctcagcgctcagcgctcttcatgtgttttttctcctttatttgttagggaatgaatgagctcactagttgccttcttctgccataatttttcttccttgttcacatgtggttggtggtatatattttagtattcctttttgtttgtttgtttttgagacagagttttgctgttgttacccaagctgtagtgcaatggtgcggtctcagctcacctctgcctcctgggttcaagcgattctcctgcctcagcctcccaagtagctgggtttacaggcacgcaccaccacgcccagctaattttttgtatttttagtagaaatggggtttcaccatgttaaccaggctggtcttgaactcctgacctcaggtagtccgcccgccttggcctcccaaaatgctgggattacaggcttgagccactgtgcctggccaatattccttttaaaatctcaaacctgccaaaacatacaggagggagaattattagctcatcagattcagtatatcaaaatgaacctgctgacaaggtggaacataattcacagactacagctgttattaatgtgtgactatttctggcaaggcccagggtgcacaatcagaaaactattaatatataacaggctgaagtggaaatgtgaatgagccaatacttggaattcctatagtatttacactaactgttcctctgcccttctgaactgagtacttcgcaactcataaaatacaatttcctgttttccactttgcagcctcttcacatctcctatttcttctggctcctctaattaatggaaacacttgcatttgagttcgcatcgatttgcaaaacattgtttaatatgagaatattttcaccgtcgagggcatgttgattattcctaggtgtaaaacattctagtcaaatttaatataagaaagtaacatgcattgtcaataattacatgaaaaaatatggtggaagatttttttctctgattaatgactcaacagttttaaacatgtgttagtgggctgggcacagtggctcacgcctgtaatcccagcattttgggaggctgaggtgggcagatcacctgaggtcaggagttcgagaccagcctggccaacatggtgaaacccagtctctacaaaaaatacaaaaattagccaggcatggtggtgcgtgcctgtaatcccagctacttgggaggctgaggcatgagaatcgcttgagcccaggaggcagaggttgcagtgagccaagattgtgccactgcactccagcctgggtgacagagtgagactctgtctccaaaaaaaaaaaaaaaaaagtgttaatgaattctttaaaataatacccatctcttcgattcatgaaaggattctttaaactcctctgcaagagcctgagtctgcccagcatcacggtgatggcctccatggtccctcttgctcagggagcagctgctttgcacctgggactctgcacgctcaccccattcagtctcccgggtgctccctggcaggtgcaccatcatcctcatttgatggtcgagactggagcgctaagagcgttggtgcacactggtgggacccaagctcaggtgtctgtgagacaaggactctgccctccagtaatgaggaaggtggcatcccctgtccctcaggaagattattgtttatttgaggaagtgcggtgtaaagacctgaatcaggaaaggacaagtcaaggcattgtggcatccaatggcatcttaaatgcctctgggagaaggaggtcactgggattgagaacattcagaaaagatttgtgggaggaggctgaacttgggcagacacttgaatgaaaaggatgtggggagtggaaggagcaggcattccctgcagtggggtgctgagattcagagaaagaagaggtgcagggtggtgtcttgatgaggcactaagaccagctcacaggccgatgagggtgagatctcgaaatctgtctgttgtcacactgcctctctatactaacagttttttagtgaaaaacacagtgagaaccagataagtgagttcactgaattttatttccaaaaaaatggaaagctctagtaacgttctgcagtaacactttggctcatgtctaagttctttttttctttctttctttctttcttttatttttttttgagacagagtctcgctctgtcgcccaggtgacatttctcacaatagcaaaagtttgaaatatgagtgttcatcagtagtggaatgattaaattagggtacatatagacagtgggatactctgaaactgttacagatgatgatatagctctaaaggaaattgtctatactatattcttcagtgaacaaggtaaattagaaagtattatatagttttttaaattttatttatttatttattttgagagggagtctcgctctgtcgcccaggagtgcagtggtgcgatctcggctcacggcaagctctgcctcccaggttcacgccattctcctgcctcagcctcccggtagctgggactacaggtgcccgccaccatgcctggctaattttttatatttttagtagagacagggtttcaccgtgttagccaggatggtcttgatctcctgacctcatgatccgcccgcctcggcctcccaattttttttctttcttgcattatgcatttttcatcaaatgcttggcttcgtgccttctaccatgaagaccccacttcacagcgacacatgctcttgggtcactccgccacccgtggggttgtgaatcaagttcttcagggagagaagacaagctgacaggggtgggacttgagttctgtgcatctgtgatcagattccgcctccacagtgctgggtggtgggaggaagcccattcatctctgtgagactaaagtccctcatctgtcaatcaagatgctaaattttatttatttatttatttagagactggcccttgttgtgttatccagagtggtgtgatcatatgagatgctaaatattccctcgtgggttgtcatgaggttcagctgcaaccctggctggcacaggccatgacacttccagcaatgtacctgcccagctgggattaatcactgacatttaactcccagttgatggcacctgtgtacggatgaattcctcaaaacagtatcagaatcttacgtactcactggtctcagcgagtattcacagagaaagcaagaaggatggtatttgattactcaataagtgagtcctgaggggtcattgctaggcaggctgaggggtggtctctgcagcccctcacagcctttgaacagccagaactttgattgatgaacaggtgctttcctgtaaaaagcaagaagcactatggaatcacagtttttgttgattttttcccctgctggtagtctggtcttcatgatatcattcttccagaaagccaaccctttcttgcaaaagtacaaggtgtgctcaggaaaaatgctgctagtgccaagattcctctttccatttctgtggccctcaggtgtggacatcgctgccttattttccctaaagtgacaaacaggatcacatcacatatttaaactctgaaatcggtattatgaggtttaatctgtatccatgtaggttttatcttgttgcaactgtttccatcctctcgcatttccagtgcccccatattgaccaggagcaccatctaggcatccgtttgtgttcctcctgccccccacccccaccatgcttctgtctgtcttctccatgagtaggaggaggtcacttggatcgagaacattcagaaaagatttgcaggaggagactgaacttggagagatgcttgaagggaaaggatttggggggtgtgcaagagggggcattccttgcagtggggtgctgagatacagagaaggaagaggcttagggtggtgtcttgatgagacactaagactggctcacaggttgatgagaacgagatctagaaatcggactactgccatgtcagctcacttcatgaatatcatgaagaccagtccaccaggaggatccaacaggaaggcaacttttttaagcaaagggattctagctctccactggattaccctgtttcatatgtaaaagttaggttaactcggaacaggagatgcaaaaaccccatctacttagagaaagctgaggagaacaaaagtagcgttagctggagacatatgccatttgttggagtgtccactgagctcgtgcaatactggttgaagccacttctcacagagatgaagcaccccgtgggtgagcctggaaataaaagtgcatggagccaggctgtggatgacggaaatagtaaatggcaaagcagaggagggcttgagcatgggtgggcaggtgagcaagcgtgcagggtgcagaaaccacagctgtgagaaggggcttttccagagtgaggttacagaaagatcaagtgaggcaggacagcatgtggacctggaagagaacataggcaaggggcgaaagagtgtggaaagaagagaaaatgaagctatatagacttcaagtaacagcatcattgctctagaactaggtcattcttggtctctgagctccggacaaattctgaagtgacctacatcattcatagaggcagaaggaggctaccattcattccagcaagcagggaaggctttcttgatatgtgctggtcccagactaagcctggaacacagtgacacacagtccttgccctcagggaactgaaagactaggaggggagggagtcatgtccataaattcaaaggccatagttgctgcaagatggcaatgagatgctaggagactataggtgggttttctagccaagtcttgggagaattcaggaaggcttcctggaagaggagacatccaagccaaggctgaaagagcaggagcccagcaggtgggtgggcccaggccatggacatagcatctccaggaggatcatgtgatccacccagactctcatctatgttgtttgcttttaccatgtagggtccctaccatttattttctcatatgagtgaagctgtctccttcaccagcccccacattatcatgtactgttttcatccagtcctctacagcctccccccaaccgagccccacagcccctgctgccaaagggattactgtaggctttgggacattctggactaatcccacgttcttcacccccttttatgtcagtcaccaggagaagctggtgactaaccacagttggtagctctttgtacgccataccttccccgactttctcttctgcttattttttctgtttcttgtttcacaatctgacatctcatgtgtctggaaggtcagctccatgaggtcaggaattgcctacttttttttttcaactgttgtacactcagcacctagaagagtacatggcatgcagtgggtgctcaaaacacagtgattgtgctgagtgcaaaggctcagcctgtaatcccatcactttggaagaccaaggggggagtttcacttgagcccagaagttcaagaccagcctgggcaacatgacggaaccccatctctattaaaaatacaaaaaactagctggatgtggtggtgcacacctgtagtcccagctacttgggagctcgaagtaggaggattgcttgagcctgaaaggtcgagctgtaatcacaccactccagcctgggcaacagagtgagagaccctgtcaaaaaatatatagtgattgaatgaatgagttatactgctaaatggtttaaacaattatctaaacattgtttatgttcttttgagactttgaagacattgactttcaaatccagtagtttccaaatttaatcatcagaattacttggagcactttttaaaaatgcccaagtcttccccccaaaactcttggagtagttacttcaggatatgcgactctgagattttggttttgattcagatataatccaggcattgggaccattttgcaaaggagagagtagaccagagataatgagtgcattatctctgccagggtctgctggggagaacctgccctgatgcccaggccagcgtgctctggctgcctggcttatgtctaacaggagctggagggcatgagggtgggacgctactgttcacatcacagggaagatgtgaatgggggtggtttggggtggagcgttgaccaggcttttaagagaactgtgggtttatgcctggtaatgataaaggaaagtagatttcaggtgcagaaaacatatccgttgtcatttaagtaaagttagaatcataggtctgagataatttaatagacttttccatttgtcaaagatgtatgtcttatttcccagtgatctctttccttctcaaatatacttgctactacaaatgacattccaagagcccatttcagtcccctgagcgttttgatttttctttcgagcagtagacctgctgtagtttaagctggttgggaaagctgtcgttcaccttgatggattaccgtccccgcagtgagcacccagtctccagaaagttcacggctccctcaccttatgtatctgatttatgtagaaacgtcgataaattagttaggagggcattcttgctgatatcagcaatcccagagcacctgggaggaaagcagagtgaagattttgaaagtcacaggcgatgtcggccactctcctgtgtggcccaggaacctcacacaatgataagataaggaagtttaatggatggtgctgccttctgaaagattaatcgtgccttgaaatctagatattttcatttcaggctgaaaacagtaaattagaaattaataaaaaggagatgatttcatcagctcaacaagtgcttctgatttcaagaagttttccttaaattttttttttcactgctgaaaaaaatcagtgtcttgataattttatgaagtagcctgtaattatttcactatggctttgcatctgagaactgaccatttgtgttttgaattcatgtcaaacaataatatattcgatagcattttatgatttattttagtgcctaaatatttataaaacaaaggcagggttttttattttcaaatttatgagctagataatgtcttgaagatgtacaacatagtatactaattttccttgcattctggcagtcctcaaaatgtaataggcaagtttattcttagacaaaagcccatttaattaaaactcacacgataactttcatacatagcaattgaattattcctaaaaggattaaatacctaagctttgaagttggatgggtgattattacaaaagccagattaatacaattgacctaatttctagtcagtgacattataagcagccttgtaagaatagctgttactacaaatatgcgggtttgcaatgttcaattctaaagtggtctaatttgttcttactacctgccagaatgtatgcattcaagtgggtgtcctccatgacagctttaattggtagtacaatggtatgagtgtggaaaggagctggtatttttcctgtttattcattaattgaacaattgattggtcatctactgcatgccagttagcttattaggggctcagatgcaagtgggggaaggtaataatcaacaaggaaatatctgtcatgtagagaaataaaggaaggtagggtggagggttaaagtaagacaggttcagtattccactggggatcagggagggctctcacttaagtgaggtaggttgaccatggattacctgggggcagagtgtgctcaagcagcacctgcaggccacagggaggctttgagttttgttctgagtgagattggaaggtgttggagagtttgagttttttttattctttgagattggaaggtgctgggttttattctgtgagattggaggtattgagtgagattggaaggtgttggagagtttcaagcagaaaaactgtaagatctgcagatgttttaaatagatgtctctgtaaattgtaaaactgtaagacatgggtaagaagcaatcattttcaggggtgagactgcttgtaggacttcacatgagcaaacgccaggcagagtgtggaacctggacccttcaaagagaaacgcaggtggaagaagcagcaaggaggaacggggcttagctgggccatcgccgccgtcttctctggcactgcccctgtgttttccgttcagagaaaagcctttcctagcattcatgacccccatcctgtatcatccaggttccacacggtcctcttctgagagaccctcccgactactcctgtgcccgttgccatgccatttgttggatcacttgcaggccccgagtctcaaacacatgatttatcatcagatcgtacagtcgtcagaagggtcccaccgtttctaaccatgtgacctgggcggttgctttacttctccgcacctcaatgtccttgtctgtaaaatggggcggatcagcccacctactgtttgggattaaatgaggtgatgtgcataaagctgtcagtgccatccctgggctgcagcgggcgttctggaaatatcacagattaccatcactgtccgccgcgcggcatccgtatgcccttgattcatacacagtgccacgcgtgggggcggttctcagtcagaaaataccaagagcagccgccgcatcttagaatttgctgtgttttactcagtccttttggggtgtcagcattttgttttctgtgtgttggcagttgatcggtaatttccaccgatgcccctgtacctcctccatccccagtcttcccagtctgcatggcttcaggtgtcacttctgggttcatgtctgctaaatttatgttggtagttttagactctcctaatcccctacttggcgttcctcatcattggtaggcacatctctgaatgtgcgtctttccagacccaaattcagctcgtcttaaactgtactcctcttaaaacctatttctccttaattcaggttacagggaacactgcctcccttagtccatcatttgggcagcttcggtcaataaccctcccctgtggttcctcttctctcagatttcatcccctctgtcctgatgaagcccctgcttctagcctctcaccagctcctcttgttcatcttggctatagatgcttatcagcaaagatgttggttcttcccaatggtgaggataaagtgtgggtgctgatgaaggcaggatagtgacctgatgtagggttctctgggtaaaacacaatgtttaggattcccctctagcacaaggttgctttaggtctcggagatcagtgcaccaagagaacagcaaccagcagtgacctctcctaatgacagtggtcatactagtatgaccatattaccagaagaaagaagagaggttgttttttaaagcactggagattccatgtcagaaaatgtgctattctggccgggcgcggcggctcacacctatagtcccagcactttgggaggctgaggcaggcagatcagttgagctcaggagttcgagaccagcctggccaacatggtgaaaccctgtctctactaaaaatacaaaaattagctgggtgtgtggcacacacctgtaatttcagctactcggaaggctgagacaggagaatcgcttgaacctgggaggcggaggttgcagtgagctgagatggcaccactgcactccagcctgggtgacaaaagagagactctgactcaaacaaacaaacaaacaactgtgctattttaatagatattcaactaagaaatgggtgggtgtaagtgatttaacctgaacccatctcagcagaaacctcagttgatgaactttttcttttctttttaaacccactttaagaagaagtacatgacaataccgcagcccctggaggttatttcatgcaggtggagagtggattcaccacatcctccagctctgagaccggtgttcagtgagaggtggttgtgggctttgagtctgtgagatcttcagtcatccaagttggattttgtttatttgacttagggtagatgttggaccaatacctcgtaggaaggtttttgaatcgggagttgaagcaaagcagcatttcttgttagtcctcagttaattagaaaattaaattaactacaatcctcattcccagagctttctgggtaattgatgtcttactgtatttggattagagaaggccccaggaggcacaaggttataattgtgtagaattagagaatctagggaagaaggaatggcaggtaatttgcaaaatttcaaggcagggggccctccccaaagtcccatggcaaaggcattgcttggtgagcacgcggggctgggccagaggctgcctactcgggagacatcagctgtgggtcaagagctacttaaaagagaattcaggagatcaaagtattgtcttccaccattcatcagaagaaaatacatctagatttaaaccctggaattagactggcttgatgcttttaatttgcatttaaagtcttaaactttttcttcttccaaatatttaccattttctgtagtccttttaagtatttggactagacttatttagaaatgtacagagtgcagaacaatgtagactcttgagtggctaagagtctaaacggctgaggaatgtagatcatttttggacttaaaatgaagctttaactgcccccaaatggaggacctccttttctggaagcaaattgcaatctgaatgctctgtgctaaagcttaaagcatagcaggagaaactattagaatttgtatagtagcattgccttggacgagcctagtgcaaactgagcctggtatgtggaccaagtactgtttatgacttttctttaagcataagttactcagggaaagtattatcaaaacaaatttggttataattgtcttcagacttgtttttctgggacttgggacttaaaagaggggagtaggctgtggataagctttggagttggcccacacaatggagattgttcaatttttttttttttttgtcctctcagacccagtaactttgggatttttattgactacttttttctccaatttttaaaattatggtaaaatatatataacataaaattgtccatcttaaccattttgaggtgtataatttggtggtattaaatgcattaataatgttgtatgatgattaccaccatctatctctgcaactcttttcattttgtgtagctgaaactctgtacttactaaacaatctcttcattcctccctcccccaatcgctagcaaccaccatccaatgttctgtctccatgattttgactactcttaagtaccttgtataagaggaatcatcaagcatttttctttctggactgccttgtttcacttaatataagtcctcaaggtgcctccatgttgtagcatgtgtctgaatttccctcaatttttagtctgaatagtattccattgtatgtgtatgttacattttgctcatccatttatcagttgatagactcttggtttccatccatgttttaggtattatgaataatgctgtataccagaagtggaattgctggatcatatggttatttcatttttaatattttgaggaaccatcatactgtttgccacagcatctctatcgttttacactctcaccaacagtgcacaagggttcagtttctccacatcctcactaacttattttctgtttgtttgtttgtttgtttttaacagtagccatcctactaaagaggatctcattgtggttttgatttgcatttccctaatgattagtggtgttgagcatcatttcatatgctatttggccatttgtgtaccttttttggagaactgtctatttaaaagttctgcccattattgaattgagttgttttgttgtattttttgagttttagaagttctctatttgttaattccttattacatatatatatatgaattgcaaatattatttcctctcctgtgggttgcctttttattctattaatattgtcttttatgcaaaattttaaacaatttctcgaagtcctatttgtttatttttcctggttgcctatgcctttggtgacaataaatcaatgccaagaaatcatggacaaaccaaatgtcatgaagttttgccctgtcttttcttttaagagtttcatagttttagatcttacatttaggtctttgatccattttgagttaatttttgtatatagtgtaaggtaagggtctagctttattcttttgtatgccaatatccacttttcctaatcatttgttgaaagaactgacatttcctcactgaatgattttaggacttttaacaaaagtcatttgtccatatatgcaagtttcttggctctctacttaatgcattgggattgcgatagagatggtgttgagtctgtatatcactttgtgtggtgccttacttcatttgggctgctatgacgtaataccatggactaggtagcctctaaacaacagacatttatttctcaccattctggagtctgaaaagtctaagattaaggcactggcagatttcacatctgatgagggtgtgtttatcatagatggtgccttctctctgtgtcctcaaatgatgaaagggacaaacaggctctttcaggccttttgtaaggtctctaatcttatccgtgaacattctgccttcttgacctaatcaactcccaaagtccctcacctcttaataccatcaggttggaggttaggtttcaacatacaaattttggggggaaacaaactttcatattgtagcgggtagcattgacatcttaacaacattaagtcttcccatccatgaacatgggatgtgtttccatttaattatgtcttctttaatttctttcagcaaggctttgtagttttcattttacaagttgttcacctccgcggctaagttaattcctaagtattttattctttttgatgctgttgtaaatggagttgtttttatcatttccttttcagattgttcattgttagcatagagaaattcaactgaatattgtgcatggactttgaaattttgcagaatgtactgattagttttaacaggattttaaaaaatgggatccttaaggtttttatatataaaattgtatcatgtgtaaacagatcattttacttttttttctgatttaaattacttttctttctttttttatttttggtctaattgttctggctagaacttctaatattctgttgaatcaaataagtggtaaaagttggcatccttacgttgttctctattttaaaggaaaatatttcagtcttttgtcattgagtatgatgttcactctgggtttttgtatggattttatttattttgaggtagttctcttctatttctaatttcttgagttttttttttttttaatcataaagcgctgttgaattctgtcaaatgctttttctgcatcaattgagattattacattgattgctttttttaaagtccttatgacttcggaagagaatatacttacgaattgttatttttgaattgacctgatttaactctccagtcactcaaataatggcacaaataaaaattataacaatgattatgtgcttactatgtgcatgacactgtgcaaaacaattcatgttcattatgtagttactactcaaaatacctcctaggtaggtactgctattctttccattctacagatgagaaaccagggctgagagatgttcagtaacatgtccaagccaccaggccaggaaatagtgggactgtgatttaaactctatttaactcctgtgcctgcacttgtgagagctgtgctacacgtgtggacaggacccttattctaatactgtggagtggaaaggaaggaagaaagggagggagggaaataagtataatgatcctcttttcctataacttcagagagagtaattgtccagctagcaccttcctgaaccaagggaatgctatctcgtgctcatattgaaagaaagataaaaagacaatcggtgaaggattgtaatgaagattaaaggagcctggagcacaactttggtttccctgatatttttcattacacagagttattacgtgttagagcacacacaaagtgtattctcggccaggcacagtggctcactttgggaggccaaggtgggtgaatcacctgaggtcaggagttcaagactagcctggccaacatgccgaaaccttgtttctactaaaaacacaaaaaattatctgggtgtggtggcatgcacctataatgccagctactcaggaggccaaggtaggagaatcacttgaacctaggaggcggaggttgcagtgagctgggatcgcgccactgcgctccagcctgggcgacagagcaacactccatctcaaaaacaaaaaaagtactctttttttgcagaggaagaacattataataaatgatgaaatctatgaaacagaatgaaatgggacctgcttttggaataatctaatgaaatagattattttaaataatctagtaagataaattagatttataagataaatttagaagataaatgtaaaattataagataaatttataatataaattagatttataagataaatctaataagattattttaaataatataaaataaggtcaaaatgaaggcacttctgatgttttttttcatgagcattaagcagtgcgcaccaactgaactctagtataaagtggcttaccagaattataaaaagactgcacatgttcaattttaatctatatcttatgaaaatggtaatggaagagacaatctgcctgagaaaggaatagaagaatcacattttagttttaatttctcattgataaacctcctttagaaacgagagagtattctagaatcgtccaattgatagaaaataatgtatttccccaaatgcaatgtctttgttatgaagtcacacctgcactattgaataaaatattatccatgttgtgtgtgacatgatttcagtagaataaattatcagtgaatgacccacaataaatcatatgcctccacttcatgctgttaacacttcatgctgttaatacttcatgctgttaacacttcatgctgttaattcacttctgatggggaagctactcaaattccgatggaaatgttgatgttgcagcatttgggatgagttctaatatgtttgttcacttttaaacactcctgagatgtggatgaagaagctgaccagcaggtgtgtgatacatttgtttgcgctgtgctgtactgggaggaaagaaagcagcaaaggtgtcttctctaataaacaccactctttccccttctagatctccaaatctttctaggtcttggtgcctttgagcctttcagtcaatcttttaaataaaatggtttccaggtgtttattcgtgtcaatttaattttccctaaaaatacatttctagatttttacccaaccactgtgatgccgtaaaatatggcagaattctgggcatggtaaaactgttaggaagaatcagagcaccaaccctagatgtacataatgcgtcagggtgtgaggttgagggtgttaatgacactatattgagacagtatattgagcatctgtgaggcacaggcagtcaccagatgttgtgcatatgtagcttgttagttttgccaatacctctgtgaggtactcatttttaagcccatccctaaaaatgaggaaaccgaggggcagataatttaaataattgcctaagatctctcaactaattagtaacagaatttggattcaatccaagatgatcttaactctaagcattagcatgctacaccatcacactgccagatttacctttgagattcatttgtaggttgtatgcagtgatagtatcgcctttgttcatttgcacatcaaagacttcgtgaccaatctgaacacccttgtatttgggcaccaatgtgatcataagaagaaaacgttatctgccatcatcctatttctttttcctttctattttatggtcatatttttttctccatttcaagtagagggacatccttcatattttctctctctctctctcctggttatgctgttttcattttgcaaagtgaaacacacacaactagcagaaaatgaggtgtgccaggtgcattcacacatcacttgtctcccagagtaccagactctggtgtctcagaggcgtgattctcttgaggggggaaattatgttttgcagaccttgttcatttatcacttctatctatctcagacgttcttttcttaaaagaagcaagactcaggcacactgaaggtcatttccatgggacacacttgattgcttagaaaaacaaatttgaaaaatactttcttcagaaggaaagatattgtttctccagggtaaaatatttctgagggcttgactctttccaatgacgcctttatgtaagctgttggagcagggctcttaattgataagcagctgtgttaataattcacaatgaatagcatatttaaaacgtcaacccagtgttgattcttatggcagtatctgaggcgagagagaccaaagcaacaatgacaatgaatctttagattctggaaactcaggagaagccacactatctctagagtcaccaccttccttttttaaagaaagagggaaggttcccctctccaaaggaaagtttgcttcccaggtaaccgtgatctttgtgacctattactgatttcgtttaaacagagtctttatgttcaaatgcaactgtgtggtaaaatggccccagaatccagacatctagatcatgcctgtaacacttttcttaatttttgtatttatattggataactcatgcaatttttcaaagactccattattatttctataaaatgaagataatcttacctacacggttaacctcgcagaattgttggaaagatgaaatgaggcagtcatatatggattagaaattggaacctcctaaactccaatgccaggtgttagtttctttacatctttcttgtagtcaaaaaaaattctgggtaattgttttgagcagttatattgagaacatcctctgagaaaagaactgtgtgcatcttgccatggaaaagaagtctgtctctgcacgtaaattacctgatagggcatgagagttactgcagagaggtggatgcatgggagaacgcaggggtgggggagggacccatcagttggtgccttctgttctgccccatttggggtgtgcactttaaatggctaagaaaggatatcatttctattcaggtggagggtaggggtgcttcatggaagagactgaattttaacttagtcttgaataatagatacaatttactgaaatatgtatatatgaaaatatccttcaagggaagagagtttgccaaggtcaaacaggccgagaagtctaggtgtgttgggggaaggctgagaggtgcaccttggagggagtgcaggtgtgtgtgggaggagcatagagtcttgctggacagagacctccaggggcatttgaatactgctggaaattatttggtgtgtcctggaggtaagagagaccagggagcagtttgtctgtgcaggaagcagtggagtgtggtctgcatgccctggagaagccaaggcctgagggctctccttgcgggagacgcctcctgactctcactggccacagcaaagagaggtaggtttgctggctggaagcataaacacagccctaagtgccacatctccccagagatggcgtggagttcctctgagggaggacatggctccacgccatgttttgagcacaggtgaggcagtgacttatgagggacaatgaaaggtcaattcaagctttaggaagtaggtttggacccaagaatctttttaggtgatctctgaaattatgatcatgaatgagatcatgaggaaaggctccttggatttcccactggggccattttagcggctgcccaccagatgccatgattgactatgttattctttttatttggtgccaaccagagaatcattttatccagttcagatctcccattagtagctgatatgagtttggtttagaataagaaaactaactcttagccagataggcaagcatggaatcacacatacacatacaaaatacacctttggagatagatatttgcaggtaattgttttgaaacaaaatttttccatatattttgtaaaattttaaatttctcattgtatgacattttattataacagaaaagaaccatgaattcctcttaatgaagacctttcttgtcttcactgttattatcctaaagatatttatttagcatttggtgtagtgtaagatgaattgcacagctaatttaaatgtattactggctgggcgcagtggctcacacctgtaataccagcactttgggaggctgaggagggcagatcacgaggtcaggagcttgagaccagcctggccaacatggcaaaacctcgtctctactaaaaatgcaaagattaggtgtggtggcatgcacctgtaatcccagctactcgggaggctgaggcaggagaatcactcgaacctgggaggtgtagggtgcagtgagccaaggtcatgccactgcactacagcctgggtgatagggtgagactccatctcagaaaaaacaaaaacaaaaacaaaaaaaaaacaggtattactggctgccccctttggaaacagtacaccaaatttactgtgcctgattctaagaatagaaaattgaaggatgccttagagaagaaatagagacattttaaaataatgacaactttggaaaatagcacccagaatcccgtggcttaactttgttcagtacaaccccaaattattgatttatgattttttgaccctgagaaaagatgcagatgcagagaaaagatgtagaaatccctccccttcccctctcctcctgggagccacatagggtatgaaagtggtagagatcctttctgctgagccaatagtcgtctttaaaactctgggatccccttccttacaccttatacaaaaatcaattcaagatggattaaagacttaaacgttaaacctaaaactataaaaaccctagaagaaaacctaggcattaccattcaggacataggcatgggcaaggacttcatgtctaaaacaccaaaagcaatggcaaccaaagccaaaattgacaaatgggatctaattaaactaaagagcttctgcacagcaaaagaaactaccatcggagtgaacaggcagcctacaaaatgggagaaaattttcgcagcctactcatctgacaaagggctaatatccagaatctacaatgaactcaaacaaatttacaagaaaaaaacaaacaaccccatcaaaaattgggcaaaggacatgaacagacacttctcagaagaagacatttatgcagccaaaaaacacatgagaaaatgctcaccatcactggccatcagagaaatgcaaatcaaaaccacaatgagatgccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccagacgactataaatcatgctgctataaagacacatgcacacgtatgtttattgaggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaatttggaaatcatcattctcagtaaactatcgcaagaacaaaaaaccaaacaccgcatattctcactcataggtgggaattgaacaatgagaacacatggacacaggaaggggaacatcacactctggggactgttgtgggttggggggaggggggagggatagcattgggagatatacctaatgctagatgacgagttagtgggtgcagcgcaccagcatggcacatgtatacatatgtaactaacctgcacaatgtgcacatgtaccctaaaacttaaagtataatactaataaatttaaaaaaaagaaaaaaataaaaataaaaataaaaataaaactctgggatccaaaagacagactcagtgatagtttcccaatactgttattgggaaagcaataaggctgaataaaaggaaagacccttaaataaagtagaaaagatttgcatgtgacaaaactggaagcagagaaactttaaaagcacatacattttgttcaaggaacaactatagttcttagtctcagagggatttaggcatttgcccaagattatgatgtgtaaaacagagatgctaatagctaattatcagagttatttatatgactgtgtcaggtacctgcctgaaaatgctcaacactgtccatcagtaagtaagagcaccagagaatgactgtctcttttctttgtggttctaacgtgtcacccacgttagttccctggactcagcaggtcgccaccgtgaggccccagcatttgggtccatcactggcgatgtgctgctggcctcagaatgtctgcctctgactatgcaggaggttgctgtgtgatagagtgcgggggaatcaggacaccgcccaccgctgtccaaatgccaagtggcgattcaggtaccttaggaggaaaagggacatggtgaggactggagttgcggtagatgcctcctgggtgttgaagagtccgaaggatccagaatggcagagaggggaaatgggggcagccatgcatgaagacaggctggggggcgctaatgcagctttctctcctggagcctctcatctccacctgctgcggaagctcctgtgcatccaactctgggctgggaaagcaaagagcactgggcaatcacgcctttctctgctgtctgcacgtggcgaaaatgaaagcatttcatggaacctgtttggggcacgtgaagagtgggccagagtgccagggaggcagcaatctgcaggttgcgttcatgccgtgacagtccattcaggggtgcaggagctggtagctgagttccccttcctgttttacacttctggtcttttggttctcaatacctcggggtgtaaaggacagctctttatttggctgtgaatatccaccactgtcttcctacttctctttctttggaagcatttcatttccttttctagaaaatttggagctgaagtgctcggaaggccactgattttaagctcattaaactcacattcacctttgtcttttgttgaaaaaagttaatcttgttttccaaagggccacaggaggatattgtatggatgttatttattgtccttcacaaacacaccccagagattagctcattataggttttattcaacaaagtaattattgcagagaggaagctgagcttttagtgatggacttggaagtgatgggtgaccactctcactggactccagatagaaacagaaatcaaagccgctgtctaatcacacttcactcctccctctgcataggactgtaattggtactcaaggagaacactaaatcaaagatctcataaggcaaatattagcagcatgtatcatgtaaataagaataatgatcagaagctacgcagaggagggactattgtgctcaaaagcagtggaagaaatcataaaagaaagatccataaatgttccttgaagacaacaacattagactttataaaataccacacagaaaatcagaaaagagcctagagaaaatatttaccacaaataagaaggattaccatctttgagctacgggagtgcccatatgaatcaataagaagaaaattacaaaggccaaatgcataaacagccaaggacatgaagagatgaatggaagaaagagaaaataggaatgatgaccaggtcgaccagaaacattcaacttaaccagtaatgatggaaattcaaattaaggctaaaaggagacagtttgcttataaaatcagtacctatttcaatagttgtgattcgataaaatggactcctctcaatacttggtatggctgtaattggataaaagtgttctggagaggaaatcaaccttatgttgcaagagcagtaaaaatgttgatatgctctgatacagaaattccacgtctagaaatttattctaagtaacattatgtacagacccaattacaaaaaaaaatgcaccagtatgtttatgatagcaattttttaggttgtaaaaatagaaaaagacatccattaaaaattatgcttagaataagtttagtaataataacaaatgtgttttgtgcctatgtgtgccaagcgtcatacctacataaatatgtgtgtgtacacatatacgtatgcaaatgcatatatttatatgtatgtgtacatttctatgtatgtgaattttttttcatttgatttttcaccaaccctataaagtaagacccattattatcccagtttgtagatgaagaaactatgacttggagagtttattagctcaagcaacaatcatacacccattaaattacatagcgcttcctccagatcttcaggtccagatccagtgaaaaggaaatgatactaggtggaaatccctgtggtttgtttttggataaaagtttcccaatactaggtaaagatgttcaggtttaaataatgttttgtgacgtgcatgtactggtgttttgcttgtttttccttctagctacacatgaaaataaggatattttccttgttactataaaagtattacatattcctttaggagctgctttcccccccttgtttgtcgtctcttaaaaaaagcattttctaagcagactgagaaaggagtctattaacaagcaaattgcatttgtgagtaagctgaagtgtagggagtggtatttcccactggggctctggaggctcagctccccagtgcagtggctgaacagggccaggcagtgtgaggggactggagctgggcactctgctcagggggtggacagagaagggaacctgggaaggcccccggcaggcaggactcagaggctctcaaactgctctcagatctgcaggactggcttcccacaactctgttcatcctcctccatcgcaaaatgaatatgtaaaggttttccttttacctgccaaagacattttgggaaagtaatgtgaagatttgtactttgtgaatggactcatatttatgtgtacaaaagcatgcagcagtttaaggaatcctatggtgaatactctgatacagaaggaagaattatttgaaatgcgatgcgtaacataaatgacctttcaactgaagttaacttagatactggtacattaagttttctaagaaataaatataaataaatcttatattaatgctagctaaaggcaaaccgggaggcatgctgtaaagtctatgcaaaatctggatgctcatggagaagattcttgtcaaatgtcatgtattattagtataggtagtctcacccttctaaaaaaggaaaccagaagtttgccagccaacctttaaattttgaaaaggtaagtctacagtgtgcttttcatacggttttcaaaagcagataaacattctcttttattaaacacacttctcaatttagtcatggtttgtggaccaatgttttcttaaattatttcataataattttacaacactgagaactggctgtgaaatcaacctttgggaaaaattaggagtagccgggggatgcacacacgcatgcacacacacacacacacacgcacacatgcacatgcacacgcacacgcatacacacacacacatgcacacatacatgcacacacatccacgcacaaatgcacacacacacgcacctgcacacacacgtgggtttgcatgctgacttgacatccaatgctaacagttcaaccacatttatggtttcataaatacaatgaatcatgagtagacctctaggtcaatggttctcaaagtgcagtcttcagaccagcaccatcagccttctcctggaacttcttaggcaaattctgaggacccattccagactgagtcaaaaaccctggataggtcagttattccttactacctttgcaaaacaccattctgttttagctcatggtgatcaaataaagagcaggatgaatgccaagatagagtatatagaacacctgatatggtgttctttggatcatgaccacacatctgttcccagcaaaaaggaattgtgccaacaggatgcatcaatgcactcctaatcagtgtcacctgatcatccactaatagctcaggcaaacatcagcttttccatcagtacacaaatcagtcattattcttgcctctcatcttagtgacagtacttcattgccccagcctacttgtcaaatccattgtcctgttaattttctccacacactccagggagataacagaatctctgggtagcagaccccatctcatgcctctgatatttataattgtgctgccaacctcctcttccaactagaattcctccccatgtttaaatttccaatttaatttcaagattctttgagaagattcctccaagtcttccctgttctgaaccatgtataactcttctgcagctatcatttggttcatcatggttcccttcatgaaaatcattttatgcatgtaatatcttaactgcccaaatgttattgaaaaagttttgagaggaagaactacatctcacatgcctttgtatctttcagtgcctagccactgtctcaccacaagaagttatagtgttttctttgatgcctttaatgtagatgtagattttcgctacaacgattttgccaggatgtgtttaaagatattcacccttggtcccctttctgcagttccttggatcatgaaagatgtgtttggtttggttggcccttacagttcattttccttttgaatcccaatttaaaattttggatttttaaaaaatagaaataaaacttatggctttctttaaaataaaagaagacttagaccctaagtctgcatttttataggagttgatgaaagtttatgcccctttgaggagcatgtgaattccaggctgccatggttctcagcacttcctaatataccgtgtccaatatggagattgagttctggattattacctgcctgtagtactgattttcttagattggagaggattctccatcaggactgccaggtttctagcattggctttgcaacttactagctttatctaagcaaccttgtgcaagatatttaactttgggaacagtaatgatacctaactcataatgttgttatcatgagttaataaagtccttaaaaccaacctggcacttactgagtgcgcaagaggtatttgctgttgttgtcataattattgttagaaatagtagtaatagtaggaaattcaaatgtgggaagtaattctagttggaggggaaggttggcagttgtagtaatagtatttactaatgtttcaaggtagaaaaatgaaatatgaattaggaaagttacatgttccaagaaaaatgggacacatttattttcaaaaataaagaatgttcctgtattcaatgtgtaaatacagtgttttggtctcaaggagactataacttaagatgtcagctaatgtcactgattacctgcttgatttatgttgcttcattaaattcaagttagaaaagtgggttcattcttgatttcttttatccaaatcctactatcagttttatgtggttattgtttttttaaatcttttcaatatatatttttatattggaataatgttagatttacagaaaagtttcaatgatagtacagacggttcttatttaccccttacacaatttatctcttgttattaacattttacttttctgtggcacattagtcaaaactaagaaactggcattgatacacggctattaactcaactatagactttctttggatttcaccagttttcccatgaatattttctctctgttccagaccctaatgctgagttccccattgcatttgcgtgtcctatctttccagtctcctctggtctatgacagtttctcagtcttcccctgttttttttttttctgaccttgaatcatttatttatatcaacatttttatggattgaattgtattccccccaactcaaatttatatgttaaggccgggcctggtggctgatgcctgtaatcccagcactttgggaggccgaggctggtggactatttgaggtcaggagttcaagaccagcctgaccaacatggtgaaaccacatctgtactaaaaaagtaaaaaaattagccaggtggtagtggtgcatgcctgtaatcccagctgctcggaaggctgaggcaagagaatcacttgagcctgggagggggaggttgtggtgagctgagattgcaccactacactctagtctgggtgacagagtgagaccctgccaatttatatgttaaaattcccaatacctcagaatgtgactgtatttaaagattggtcctttaaagagataattaaattaaaatgaggtcatatgaatggaccctaattccatatgactggtgtccttataggaagagattaggacacagccatgcacagagaaaagaccatgaaagtatagagggagaggccaccatctataagccaagggcagaggccgcagatgaaaagagtcctgctgacaccttcatcttggacttctagtccctagaactgtgaggaggtaaattactgttgtttaagtctccaagtctgtggaatttattatggtagccttagaaactaattcaagtatggactcatataagtcatctttgaacttttcattacaatccaattctatgttgtttatatcgtggctcaaatgattccagctttgacgtggtctccctctcatgttggttcctctgtcctcttagcatgtacctacacttgtgatttttgggcacttttctgatactacaagatgttccaggtttgttttgttttttccttgccctggcgctaaaatcagttatttctccaaagagtgaggttccttttacttgtgaatggcattaaaaaaccaagacctatggtaccaggttttgatccctgacctgtggcaccactttcaacataccatggttctgtagcagtgctggctgggaggcttaattcttgcctgttaagcatggccttcagtttggaagcccagtcgctctccaaggtcctgattttgaaaggcttttctttattgtgtgccaggaaagacagaggagaaaatagacaagaacataacatttaagcacaggtacagtcattctctgttcttttcacatttatgatgctaataaaagaaggaagatatattacatgagttaaagaaatttagaaatgttagaatttaagaagtagtgcctgtctctttgcaaatccatttcttgaagaggacaagtgagcctctttaaggagaaaattcaataagatacgtggaaacagagcttacataacttcagattttcctaacatcgtgtcttagggatgacagttcaagagaaaatgtgctaaagctgtgacttgaagggtttatttagatatgtgcatttcctgacaggcgagattagtggattctggaaaaagcaataaaaaggtttacagaattttcttctaattctgctgataaacagatgcaaactggcttaaactctgctgggattaaaatatttccgattcagtatttcatcaggtataaatgtggtttttcatccacatttcatttatgaggcagatgaaacattgagatctttttgattctgtgcatgcatttgatagtacacctccttggataaccaatattatgatatgcaatactttttttctacatttctctaacatgctgatctgtggagataggtggaggaggtagtgcttgttataattaaataatcacacattagttttcactaaggatctttcatcgaaggatgttaagagcaaaatggattctgcattattgctgcagtagatttttaattttactgttaataagcattaaagtcccacagcatgcaatattttgtttcttcccttttaaagaattaaatttggtgttttcccttagagcttgattgatttgctagattaaaaagcatttaaaatcattgtttaacacatggaaaaacatattgattgttgcagttctttataaagaaaaaagtacagtttggttccctgaaaaatacatgaattcttttagctgactcttagaaattaagacacatgtatctacaagtaggtttgggccaagaatgttccctgccccaactccgtgaaaaatttccattacatcagatacttctaggattgtatattcccttggaagatcacaaaggacatccgtctccacctttgcttaaacctaagtgatctttataaagaaaagactctttaatgtttagtagagatgtcacagaagtagacatatattagcatctttaaatgtctgctcagatttttcgtaactctcattgcattcatcctcctcttcaattgttaaaaattatagtcaattttctaaatttcaagacaggatctcactcccattgcccaggctgaagtacagtgtcgtgatcatggcacttgacctcctgggttcaggtgaccctcccacctcaccctcccaagtagctgggaccacaggcatacaccaccatgcccagctaattttttatatttttagtagagaagggatctcactatgtggccaaggctggtctcaaactcctaggtttaagcagtctgcccttcttggcctctctaagtgcggagattacaggcatgagccacagtgcttggcctcaatttttatctccctagaatatttatgattctttctgaatatcagttgcaaacccaaatctatatgataactaatcttccagaaattctaccccacaagacagagtcaactgtatacatgaagacatttatgaactctgttttcttttaggctcaacgatacttcttggcatatttttaacttttgtttataggccgttattaattttgaagtacctggtattgcttgtgtggaaataaatctgcattcgagtaattttaactctatgatttgggcgctaataatacttattgcaagagcatcctgaagtagtctcgggctaggtaattcatctagttcatcctcttcgtttcaggaaagtggatttcctagcctattcaagcagctatcacaaaataccccaagcagggtgtggcttagaaacagcagaacttgacttctcaccattctggagaccgagaagtccaagatgaaaatgtatttggtgtctgctgaggggtcactctccaacttcaatagcacctccttgtcaagtcctcgaatagtggaaggggtgagagagctctgtggggtctcttttatcagggcactcatcccattcaggagggttctgccctcatgccctcatcacctcccaaaggccccacctcctaatcttgggggttaggattttgacacgtgggaaacaaaaacatttgcccatagcaggctgctgggacagaatacagttcaggggctgcaagtccaaagccaggtgccagcaaagtcaaagtccaaaggcaaatgaacccagcagggctaatctccagcaaagcttctctgcttggcttgcagaggccagcttctggctgggtcctcacctgtcctttctgaatgcacgcactcttttggggtctcttcctcttcttttaagaacagtgccctattggatcaggcctccccacctcatttaaccttaattgccttcttagaggccccatctctaatgcaatcacaatggcagtgggggctagtgcttcagcatatgaattttggagacacaattctgtccataactgtaggtttttggttatctctggaaatggaaatgctttactttctaatttcccacaatccagagaagcaatatctttttttttcaactttagaaatcttttgaagttttgcattgttatacagcacttattcaatgccgcccaatccgagtgacttcatctcactcgacgacctcacctgactattccctggcctctgccctgcccagggcacacactgtggcaggtgagtgcttgtgcatgggcacacaaggcagatgcctgggtgttctgggcgtgctttttgcctgagatgttccatgacctggtctggtgtctcacaaagcctcctcatgagaaacacctttcttagggaaataccttgtgttgctcttttagaagattccacatgtggtccaagaggcatcagcatcccctgggagttcatgagaaatgcagctcagacccccatcccagccctcctgagggagaacctgcacttcttgagattcccccactgacctccaggcttaggaaagtgagagacacgctgccctaaagtggtcctcggtatagattcaaggcagctgcccaccccagtcatccaattccttgggctatcttaaattcttttccagtctcttctacttagtttaaataaatcaagtcacactttttctccagggactcatttccctcaaacactatatctgatgtttctgcacctactgggtttttatgcagttatgcagagatcacaggctgtttctatggatctttgcatattgcaggaatctttttgatagtgaggtaatttgtgctgaatcaaaaggctgacatgcaaagagagtatggtggcgtgtactaaaggctttatggtaatttttgttccatttcaccatcttttattcatatgccattttgatttttctagagcgaatatataggatattatctgaatccattttctcaaagctacgttttaacaacatttagtttgggacatttatttcgtattgaacacacaaaatgtttgctaaataaaggcttcaaatagcaacccctcccctgtttggtattttttcattgtttatcattggacttttagaagtgtaaataagatgtgtgagtcaaattctttctttgtaactgcttgaaaaattcagtaaccaattatttataataattggaaattaaatgagaatcaaaattcccagtgagtatatggcaagtttgttatttcctttctaccaataatgaatgataatgagtcaaataaaagcaatttgctttttcatgaaaagtagtgatgattattttaacaatcacaaaatgctttcctgaacatgttcttttatcatttctgtagtattgaactttaaaaaaagatatcattgagaataagtgaagcatggaacctgtaaattgcctgtttttgaagccatcgtgtccatcatttttagtgagagaataatgttctgatatctccacttgacatcttagactctattgtgttataacttcccacaacttgccaaagggccattctaaacttttgctcttcaatcggccatcattacgggaatattggcttccaatttttgtgtactaatatgaatttggctcatgaatgttactactccgaccaacaaaattcaaatgctccacaaaaagagaagagcctgtctagcacaaagatcttttcagcttttgagtttcctcttccctatcaatcatggggtttaatttaaattaaaaaggaaacattctttcaagatacatagtgtgaatcaatcaatcaatcgtacagtcttcctttacctaaattaatcacctttataatccttttagtggttcttgatctcttataggatacaatcaaaattccccatcttgatatctaaagcttcttaagctgaatcccatctcccttatcacttctttttatcatctctctctctactttcctttacacatattctattccaaataacctacatgttataccccaagccttactcagtcattcctcagagctgcgtttttatctgtggttacaaaacagatctgctgtcagaccagtcctgacttgacctttctgtgaggttgccatcaggtgtcggctggggctgtgtcttctgaaggatagggctggatagggctggaggagcctccacctaactgtcccccttgtgtggctgtcaagttagtgctggccccacacaggttgccgaagggtgctcacggcatggtgcctggtgtcttccatagagatacacgagtccaaatctgaagctctggtggctttggtaatccagcctctgaagtcacacactgtcacttccagtatgttctgcaggccacttgtagccagccctgatggagtttggaagggagtgagtagcaagaggcctgggtcccaagggtcatcttgaaggctggccactgcagggcctttgtccataccaacaaagctcaccctggcccatctctgcatgcttccttccacaccctgatagatccttcttcctctaggagccttcctgacccactctagattgaagcaactcaccacacacctgaaaccctttagcacatactatctagaccaagcaggtggtacatgttatattcacatgtagaagactcatccctggttgagtgacactctagataaatcactcaaggttccagctcttaaaagattaccttccatatggtggtatgaacagagattccctaatgaccactactcagaattaagaaggtaaaatatgccgcatataatatattcaattccttcaacactgtgtggctttggctaaagttaacttgccttcctcaagcatgcttaaatttggtgtgagtagtaggtctgtggcaactttgcagagttttgtggagaatttcctattacaaattctctaggttgtgagctctgcggtacaagtggctatgtgagactaatgagacattaagatcctgtttaaaggtgcctgtgggtccctgagctatcttgggctcccttctgaataagcaaaagggattaacttgggctcagtatgatgtaggttaaattttgacccagcagttgaactcttttagaagaataaatctattgatagtagcgttgggcagtactctgtcatctagaatgccccattttctggccaggctggagaagtgcattttcagtactggaaagctgagtcattttccccgttacagattgagttggacacctcctttgaggcatccaaaaatgacagggatttcagatgaagcaaggctagaattgtactcgatggacttgaacttgaacctgcagcttctcaccctccctgctacaacccttgtgttggagttgcataacttctgggagaaccatgccagagagttatagtagtccccacttatcctcagtttcactttctgcagtctcaattacctgtggtcaactgagatccaaaagtattaaatagaaaattccagagataaacaattcataggttttaaattgcacactgttctgagtagcattatgaaatctcacaccgtcctgctccatcctgctccgtcctgttctgggacatgaatcagtcctgtgtccagcatctcaggctgtgtacaccaccctcccattagtcagcaacatcatcttctgacagccaaccatggacatcatcatgccgatgattcaggatcacccaagcagatgatcctgcttctaacctattgtcagaaggtcagtagtaagctaacacaacacgatgcctgtgtcattccccagacttcatctcatataggcattgtatcatctcagatcatcacaagaagaaaggtgagtacagtacaggaagatattttgtgacagtgagagagagagaaaccacagtcacataacttgcattgcagtacattgttatacatgttctattttattattaattctaaaaataaaatctcttactgtgcctcacttataaatgacactgtatcatagctatgtatgtataggaaaaacagcacatatcaggttcagtgacatctgcagtttcaggcatccactgggggcatccccttggcgtgtattctcccccaccaaggatcaggggagcaattgtaattctctgctaaattctagtctgtcaggatacttagtgtttacgaatttgaataaatatgagtaaaaacgaattatagaaatgcggttttcctgctttcaagtgcaaacattgacctcagtggacaactcaggaaacgtttctagatccagcttctaggaggcctgtggctagctggctccctctgtatgcaaaccattcacatgcaaaatctcttgagcaattcctgtctaaaaggggctcataggctccgtgaaatcatgtttacagtttcaccttgcttaccaaggcctttttggttctagacaaaaagtctattacaacccatgtcaagctgtgatattattcaaatcactggagtctgatttcaatgatcgttttctatgcacagcttcaggatactcagcctatcacccaggaggtgaatgaagcaagtctgaggtgtctgggctacttgactttcgggtgatctcagggaacatctccccaccaattactttcaagactgactcgctgacatggaaattccttatctggaatggtttctgtctgtggttgcaatgcttttccaattttcatctacatgaaactctcccagaaatcttaaaatgtagtttttgttgcagtaggtttggggtgatggccccccatgctgctagtccacgtaccaagcactggaggtatttaaatgcacaagcccctagaaaaataatgcctgagactttctaaacggaagtcctatctgtagctcaggccattcccgtaagccccagcctgtgaaggctccctaggcacctgaggtgggctaggccctgacctgatttcatgacttctcccttgggtttttccctccccacctcccaccccgctcccagaagcgaagagatggcttcaccttctttactccctgccttgggcagtggctccaacatcttcacactctctcaagtcggacagttcattcatcttatttcctcactcccaccacaagtcagttactctgtcctttggatggtgatcatgtgcatgatggctgtgtcatgtttcccatctgcatttagtcctccccatcttcatggctactctgtgccagctactctgtgccaccctcatcgcctcttgcctaaactcttcaaaccagtgcaaaagcgacctcttatttgcttttgtaattcattcttcactgttttgccaaagggccattacaatacattgacagaatattattacccttcctcaaaatcatttgtgtctctccatggccaaaaccctttcacaagagatcactttgataaacaattaccacctgctcatagcctataatccaaccatactgggaaatgtatcctttagtagataggacctgcatttgcaggagtctttgtctcctaattttccttcagccagaaaccatctcctcctccagcatgccatagcagaacctaaaaagtctgcttcccttctaaacttctgtgtcaatttcactttctgcaggaagccaaccccaattccaccagccctgttccaaatcaggaaaacctgccccaccttgcctgccactagctctggctttggtagcatccttttgttctgttagtgttgttcacttaagttcttcttacaagattgtaaattttgaattacaaaaactttgttttattaatctttgtttctcctaagtcagccagcaaagaaccttgtttacagtaggtgcttaataaatatttaatccatttatcaattgaatgcaagcgtttcttgagtgttttttcttagattgtgcgaaaggaaagtgtgaaagatgaaaggaaatcccataatgaaataatgaaagagagtggacaggggacggctggaatagctgatgtcaaatgtacctgaaacacagctctatctgtgagtcctagagggtaggaaataacagtgacctcataagaaaccattcctctccctgctccctactttacaaccagattatattacttctgccctccttgggaaatgctatgttaaatgttatttttctgcaatttgtaatgacctttatatctgaaagacagttcctataaaaacatgagattgagaacccatcaaacaagtatctctaccatcaactaaaataagcaccatggacccttcttaagaagtgagggtctcatgtttcaggacaagcgtgttcaagtaccaccagccaggaaggccaaccagggcaaggctgtgcattccagaccctccagggctatggcgtcaggcacttgacctgtgttttaggcaattgtgagttaatggaaatgatattagcaatcataggcaatgactaatatttaccaagcatttagggaattggatcagtgactgctggaaatggaatacaagaattaatgttccaggaattaataatgatcctcagaaaagcttatggcttcatccacaggcttttgtcattttagtattaaaggcaaagcaatgaagagactgtggctcattcctctttccttgaatgggcgtttgcatgtttcaacacgctggaaggttaccttcttaaaatgccagctcattattcgtgtgaaagtgatcatacattggtattaaatgaagagtagaggcttatcattttagacatgatgggtatgctttatttacagatagtcatccttccaggagttaaattcacattgactattttttaaaatagtgctcacagcttagttctggatatgtttgcgttttccatctctcttggctgcttgagaacagagcgtccttaggaaaggacaagtcctgtgcagaatgcgttctcctttctcccacatttgcatttgcggggagaggcgtgcctgctgttgtgcacttcaccagcgacctcccacacccttggttctgccctgggcttgtcttcctttttctttccttctcttgaaggggttacagcccgaagcctgaaggaaaccagtctataaaactggtgaacgctgtctggatagagagaacagccctcgaattttgaagcgcagtttgtgtaagagtttatgggctctggatcatctgatagttctatttttagttttttgaggaacctctatactctttttctcataacagcagcaccgttttgaattcccaccagcagtgtgctccagggtgtttccaaaataagtgaaatcaggatgtcaaagagacaccagcacccccatgcccatctgcagcaccattcacggcagccgaggtgtggaaacaatgtaaacgtccattgaaatgtggaaacaatgtaaatgcctttgacggatggttgggtaaagaaaatgtgttatgtacatacaatggaatattattcagccttacaagagaaggagaaggccggcacggtggcttttgcctgtaatcccaacactttgggaggctgaggcaggcggaccacctgaggtcaggagtttgagactagcctggccaaaatggtgaaaccctgtctctactaaaagcacaaaaattagctgggcgtggtggcgggcacctgtaatcccagctactcgggatgctgaggcagagaattgcttgaacccaagaggcggaggttgtagtcagccgagatggagccactgcactccagcctgggcaacaacagctagaagagagaaggagatcctgccacttgtgacaacatggatgaatctggaaaatgtaatgctaagtcaaataagccagtcacggagggacaaataccgtgtgattccactcataggaggtatctaaagtagtcagactcatggaaggagagaatagaattgtggttgccaggcactgggaggagggaaatgaggagttattaatgaacaggtataaaatttcagcgatgggggtgggtagggcatgaggaaatacagtcaaaaaatgcaaagtttccatttgacaggaggaataagttttggagatctattgcacggcatggtaactatagttaataataatgtgtatttcaaaattgctaaaagagtagattttaaatgttctcacaacaaaaaataagtatgagatgatgaatatgttaatcagcttggtttaatcattccacaatgtatacatccatcaaaacattccactgtagcccgtaagcatattcatttactatttgtcaattttttttccaaaaaatcattatgcaaaatgagtaagttctacaaatctgctctacaacattgtgcctatagataacaatgctggcattttgcacttaaatctgttaagagagatgatcttatatgaagtgttcttaccacaataaaactttaaaaaataaaaataataaaataaggcaaagtttaaaaaaaaatgttcgtgagctctggaactaagcataccaggattcgaagtctgagtctcccaattactaagtgtgtgactttgggcacccacgtcacgtctgacactcagttctacatctgtaagtgaatataacaatgcctaattttcagcatcattacaagaagtatagatcctgccgcagggtcttgcatggggcagtaaccagaaacttgtagctactgttgtgtgactgccatactgtctttggcccttgtaagctatgtgattttagacaaataatttgcatgtcagtttctttttttttttttttcctttttttgagatggggtgttgctcttcttacccaggctggaatgcaatggtacaatctcagctcactgcaacctccgcctcccaggttcaaccaattctcttgcatcatcctcctcagtagctgggattacaggcgtgcaccaccacgcccagctaactttttgtgtttttagtagagacagggtttcaccatgttggccaggctggtcttgaactcctgacctcaggtgatctgcccacctcggcctcccaaaacgctgggattacgggcatgagccactgcgcctggcctttgagtgtcagtttctatgccttagaaagaggggattggagactggatgatctatggggagggtggtctaagactttgatgtgtatgagttgtaaagtaacataatagatccaaatgacaccaaaagcttttgctgaacccagtcagttgagtcaaacaagtcattagtggagaacggaaccagctatttaaattaaacactggcatgtgcctggtttattacagtggccccagtgcccagcatgttgtaggcactcaggagacatttatttaatgattgaaaagcatcagtcagagctacaggacatagaaagcacatttgaaacagttgagaagatgtaatgaagtaacaacttagtaaagaatggacagggtcaggaaagcaggaaaacgtggtgaaacattctgggattagaatcgcaagaagttgctaccaccctttggcccaagggagcagttagtgaaactcagcaaatgtctgtagttacagagaaagaggaaggacaggatctgtgggaataaatacctgaattctctcctgactttttgatctcttggtcaagcctcaaatctattggccaaacctaactaaaagctggagcacaaggaaatcaggttgaggctggtctgcagaggtcactcttcctagacaaagagcagatggaaaagggagcaaaaaggatctgcagggacaagtgaagaacatacagcactctaaagaagcttcccatagaagcaaatttgtgtatgtgggtgggaactaggatattttatttgtttggggatgcttttattacaggtaaaagcaataactgcatattttggtctgagatgtattttttctactaataaaattaataggctaataagggcaatgatcaccttcaaaaaacacacaattttcgctagttaatgccaggtctgatcagcacattttagatggatggatggttgaatgggtcaatgggtagatggatggttggatggatggatggatgaggaggaggtggtagatggataggtgaatgggtaggtggatgggtgggtggatgggtggatggatggatggtgagtgggtgggtagatggatgggtgagtggatgaaaggttgagtggatgggtgggtgggaggtgggtggcttggctaagttaggattgctacctttaaaagcatagcaatggtaacatagagtatcggccaggcaacaacatttagccagaaaagacagatccagagcagggtctcccagctggcttgcaataaataaattactttttcgtaattttgtcaaaaacgttcaatgtgcttggttttaatgaccaggaaatatctagctgtgttgaagccccccatctcagggggaggtattacctgctgatggttctcggcttgttgaaagttcacatcctaagagtgtgtgttgttgttagtgtgattacagaaaatctgcgccctctttctaacctgtgtcaaagataaacaaggcatgacacaaggtggtaagaacagattttaatcagcaacaactattgcaatagggaaaagaatacaacgtgaactaaattcaacttccatttgtacagcagtgactgggcatttataaaaggagaaggaaggagtggagagagttaagcaggatttagtagagtcagggaggtgaaaaactccgagggttagtcatgtgataatgtcggtggtgtctgcgaactggcaattatggaagttaggattccatcctcccacagagaccagacacagaggctctgtcctcaggtgtcagctggaacaagtcataagctcttttggcaggtgtgacttttctctggcaggcacttctggttgggggacagccagggccatcctaggaatgtgaccttgttctgttagaaactgtgctagtgtttgttcaagtctttatagaccgagcttaaggcctagttaaaaaaggattcagagaaatctgactcaagtttggtcaaagagagagtccttgccaattgttattctttaggcatttagatatctctgaatacccaaacagagaatacagacaaaaaggaataagcaaactatgttgtcaaggaacagttttattgtcaaaatgtatctcagtgatgattaatgaattggaaagttataagatgcctctattaatcacttttctaaatgagttgagttttgcagcacagctgaaaattttgatttcattgtttaaagcaaattttggaaagaactattgagtgcaagttaaagccggaaactcacagaggcaaagaaacatagaggatggtctgttcccctactgccatagactctataaagagcttgtttcacggcctttgttttcaatgttcctcctatggaaaaaataattgccagttttcccaccaatgtggacacatatatgaaaattttttgactcttcccaatcatttgtaaaaatgatactatcctctcctgtttttgcacgccattagagagatgaggtgcaagtgtaccataggcctagaaaccttgcaatgtcagctacgcactgtttatctcaactcacatacgcagatatttgttgcagattagggtgttgtctgtaaagaaagaaaagtgttcaaagaaaacctgctaggtgatgtatttgttttcgcttattgctgttacaaattaccacaaacttagtgacttaaaacaacataaatttattatcatatgagatccaaagtctgaaatgggcttcaagtagctcaaatcaaagtgtctgcagggctaattccttctggaggctccagcagggaatctgtttcctgcttctagaggcttctacatgtcttggctcacggctctttcctccgccttcagagccagcaatcgctgcctgtgtttttctaatatcatattacttgacaccgactcttctccctccctcttccacatttaagtacccttataattaaaattgagcccacgtggataattcaggataatctcctgttttcaagccaaccaattaggaatactaactccatctgctgcccagttcacgtaacgtagccacaggttctgggaattaggatttagatgtctttgggcggccttgttcattacaatgaagcaatttccatctgctgcagattctagatctagaagttgccacttgacaactgcgtgactttaggtaaatctcctgacacttaaatgcttccctggctcttctcatttgcaagttgaaggcactgtgttaggtaacctctgccatctctttcagagccctccaagtttgaggaatccttttgatcaaaggtgaaggtcatgaagtgtaatttgctttgccgtggttattgcattctcgttgattgattttttggattggatacccatgaagtcttatgcacatttaaagttaattatttcttcattatataattaaatgtagatgagtcccagtgtaaagtgtcagacggataacttattctttccaaaagaagaacagactcactcagcagcagcttttctgctctctctggaaaggaggtattgagtcgtcttagattaactcatggtcttcctgacaggattgggtatggattttaacagattacagtcatcttggatgccttccagaaactgattctaaactgcttttatttttcataggaaacacccaacaacactgcatagaaattagatactcctaaagtggatttgaaccagtaaaattagctgtaaatatcgaagcataactaaggtttagtgtcttctctttgtaggtaatttgtgcagccctaacatttctcccctctggagcttagctgtacaattctaatcactactgtggtctctgctcagtgggccatcgctcatgttttgaaagcactggctttgtccctatgtgagcttgctagttagttgatacatgcaggagtgtggtggcctcaggggaatggaatttctttcttctgtttataggttagtttggggaaaaaaatgtgtgtgtgtgtgtgggtgtgtgtgtgtgtgtgtgtgtgtgtgtgtgtgtttactgagatggagtctcattctgaatcctaggctggagtgcagtggcatgatcatagctcactgcagccttgaccttctgggctcaagcaatcctcccacctcagcctcccaagtagctgggcctacaggcacacaccactatgcctggctaatttttaaatgttttgtagagatggggtctctctatgttgcccaggctgattttgaactcttggtctcaagtgatcctcccacctcaatctcccaaagtcctggaattacaggtgtgagccactgtgcctagccaaaaatattgtgcatatttttaagcactggttggcattaagtttgagggttacagggctaaaacaaaagatgagattttactacaaaaagaacttggaggctcttttagaattggattcaactttcttcctgctatagagactatagattgcttgatttatgatgcgagatttgattcttcatgtcatcttgccaacacagccgctgcagttgtcttgttactccagctctttacccagcatactgtttgccagttgaatgttattcaagccagaagtttggcaaaacactttggtacaataaaaatatatttaagaatttaacattttggctttttattgtagtattgagtagggaatgggaaattagccaatgataggactactagggtctacattcgaaagaacttttatagcacaatcttttggtaacttatttggttgaggacgtactaaatacaaataatcatgtgggaatttggtgagctatggtaatgaatatgacgtgagatgacttcagaggagtttgcagttccgtagtagagacagacacgtgtagaaaatcctgtattggtcttcttccttgttgaccgtagtgctttcagtggggtgcatctcattagaacgttgtgattgggacatacaagtggaaggtttctttaatgtctggttcccatatcggtgagacatagccttaatgtattattctccagaggggcaaaccatccaagactattttagaattaaggacttgctgctctggttacttggtcactgttgagaggatgtgttggaatgacatagcaaaccatgagatgatggttttggaaaaacatcagccgagtaagttatttggtactctgccttaaaaaaaaaaaaaaaaaaaaaaactgagccataaatattcaaaaaagtttgtatgcacagaacacaaaattccaagagaattatttgtttcctaccctaggagtcaaaagtgtttgtttagaataatgtgtaagagtttcttaccccgcccccaggattaccaattcctttaacaatgccctttatttgtgcatcagtgctagtaggtttttcttttaatcagaaataattttggtgagcgtgtctatgcacacagaaatagctactaagatcattaatattttattgttgaaagcagttttatcttataatcacattttcatttgatgtttttagttttctgcttctctcacataaatgcatggtgtcgagagaggcacaagtatttttgtctctaatatcttaaaaattaggattaagtgcattctgtattgttttgtattcacaaaatagttttgaaaaagcttgagattaagtgaaatttgtatgtttttaaccatagtttttgtgggacaaatttacgctttatctctttggtttagatgtggttgacatattgatgcatgtattctctttattctgtaggctttctttttccttagaaatgaagtcacattcagtagttaaataatactttactcaaaagtacagtgatttgaaaataaccttcaactgtcagaagaggctgaacttgactgaaatgtggcctcctaactgaatattgcacatgaatcttaacagaagttatcataaacatttaaatatttgcacttggtatttagacattgattttcaccaataactgaatagatataaagcctatttttcttctttagccctcatgaatatcaattcagtttgttttttgtttcttctgggtgattcatagatgaatgcctagtgtcttcatttgcaagctgttcatggaaggaagccacttttctgttgcctctgtaaccattgcagggccttcaatagcagccttcagacactaggcatgcattcagcattggaataaataggatagccaagggtagctaattattttcaggttaattcctaaagagttaatttgcactgccttgcccaaaatcaaaccagcagaacattttattaagcaaggcttttgtgtgagtggtatggaagcactgaatcagttgctgtttcttttaatctaaattatcgtcattttgagctttatattaatacactggctgagtaactttgtttaaaagaaacctaggtaaattgatagttctatgttctaaattcttctgaataagaaaacagtgatctgccagatgaaaaaggcaattcagaatgtgacataacttctgttgagagatttttgttgaaaattgggaagtatgaattcttcacagactttcataaaatatttcaatactcttatttttaaaaaaccttgaaaagtcagaaatcagttagaataattgacttctaggcatagaaaaattcatttaaattttatttatcctggatgtcttcttttttagcataatacacctaaaacagatattccactaatatagagtgattgaagtattcagaggaagattgcattttaaagctataaagaacatttaagagtaaatgtggaaaacagtatgcagatttcttaaaagaactaaaaggatacctgccattcaatccagcaaccccactatttggtatctacccaaaggaagagaagtcgttatatcaaaaacacacctgcacgcataggcttactgcaaaaaaaattcacaactgcaaagatatggaatcgacctaagtgtccatcaaccaatgagtggataaggaagatgtggtatatatgcaccatggaatactactcagccataaaaataacgaaataatgtcttttgcagcaacttggatggagctggaggccattgtcctaagtgatataactcaggaatggaaaacctaatattgttatgttctcacttacaagtggcagctaagctatgggtatgcaaggcatacagagtggtataatagatttggagactcgcaagtggggagagcggaaggggtatgagggataaaaagacacatattgggtacaacgtacagtgttaagatgatgggtgcactaaacgctcagacttcagcactgtacgcttcatccacgtaaccaaaaaccacttgtacctcaaaagctattaaaataaaataaaacataaaacaaaataaagagaatatatagcctacttccttaggttttatagtcaaagcaccactgatttagaatctaaaggcctggcctcaggtctgattctgctactttacatctgtgtgaccttgggcaagtctcttaacctctctgagcttctgcttcttaatctgttaaaaaaaaaaaaagcataatttgtcttatccttgttttgatcaaatgaatgagttctgggaaatccatccagctggtcagtggaatccacgtgcgagcacagcaaggcctaacgaatttgctgacgctcctctgaccacctagcttcacagatgggtgggcagccagacctacaacccaacccacgtctgccaagtcccagcctttccattcacctttcaagggaagaaaacttctcatgtattggaaagcacagtgcctctagtgcctctctttcttgattgttggagttgggtctctcagcattgtggttcactacgacagagcatcgcttttaacagccacataaaataaccctcttgggtaacacactcaagaggcttcgtgaactcgggaggcaatctgggcaggcttacagctgtgtgacaacacaaacgctgtttatttgagtgttatcaggaagatgtgtcactgtcatggttgaatatggagaaacaggtgcccgcctcggaatggctacccaagtcaaggaggacccaaggctaatgtggagaccacgttcctccctggagtaccggggttaggcagggcttgaatgaggtgcagcgaggccggtgaaacacagcagtaccacgtgtcttatgtcacatcagcaatgcaggtcgcgctcgtcacagacatttcagatggagctgggtattatattccagtcctggcatttattatggtcaccaccagcacagagcgttcctggcctggtgctgtctggtttctggaatacaggccatccttcctgatattctaaagcctgcctcccaccctcaaagagtcagacggcaagtttccatccaccctcccagttctcagcctttgaaggtgagaagctcctcttctaggggccgctgtcagaatctcagggtttggcactgttgcgctcgcctccattccccaggctcctcgacggccttagatgcttaaacacgctgctgcctctcatctctggaccaaggctttcgtttccctgtgagtagacagcactaaggcacggggttagtttaatgatgcaagtcaactggggagccttgctgctatagagataccctttgtatgtttactttaacttcttgcatcagtcaattcaggctgttgtagcagaataccacagactgcacagcttaagcagcagcaatgtattccttatgattctggaggctggggaatctgaagtcagtgtgctggcgtggtcaggtctggtttgtagatggctattttcttgtatcctcacatggcagagagcacagagcaggctcttgagtctccttagaagggcactaagcccattcaccctcatgacctaattacctcctgaaggcccccctcctagtgctgtcacattggggagttaggatttcattgtatgaatctggggagacacaaacattcagcccatagcacttccccagccgtgcaacacaggtgccctttggtggtgtttgcataggtcatggctgctgatagccaccgtgtgttgactgcccactctgtgcttgacgctctgctagaggctctttatgttgtctttaatcctcacttcagtgctgcaagggctgtgttattcccagctgacatatgagcttccaggagtttaatggatggaagctcagctggcacatggtggaggcaaacccagggatgtctgactcattcgaatgtttctttcgttaagttaagtcttccattcaggaaaccaatattgcaagttcaacgtgtgaaaatgtcactaggctccacggtgctagagaggtggatcctgatgatgtcctgtgctcacggcgcttactttgattggcacccagagagaagacatgagcaacactggttgtgttcagatgagagacagtgcacctcaagggaagtgttggtgaagtcctcagaggaaggaggaacgcaaaggcctgtgttcagaacaccgtggtgccctgagaacagctgccaaggatgctcgctgggagccacaggccaccagggggaagcgccaaggccgtctttcaagatgcagttacatcatcactgagcagcaccagctcagggctgctccagcaagcctagacccaccctgcttccctgcgccactccccagggcctgctccacaccacccacaaaaggcaggcggacagtggaagaacactccaggcccccagctccaaaggctcagatagccgctgtcgtcaaaacctcatgtcaggctctgtttttctttcctttcttttcttttcttttcttttcttttcttttcttttcttttcttttcttttcttttcttttctttcttttattatttctttctttctttctttttttttttttttttgagatggaatcttgctcttgttgcccaggctggagtacagtggcatgatctcagttcaccacaacctctacctcccaagctcaagcaattttcctgcctcagcttcccgagtagctgggatgacaggtgcatgccaccacgcctggctaatttttgtatttttagtagagacagggtttctccatgttggtcaggctggtctcaaactcctgacctcgtgatccgcccacctcagcctcccaaagtgctgggattacaggcgagagccaccgcacccagcctttccttctccctttcttacccgacttccttggaattggtattcaggaccttccttttctcctggtatctgcccagtgatccaggacagcgctcagctcctggtagccctgggctctgtggtttcaggctgggtgcatctgttcctgtgccctgatctcagcctggcccagctccttggcctctccaccctccacttcccttggaagaaaaaatgggggtaacggtaaggaggtgctctgagtaaagcagtttccgggtccaaaataattcaaagaaatgaagagcaaaaatcacagtacaagtagtttagcttttcctcagttaatctgccataatattaagtaaagctagttttaagtatttaggctctaatgaattccatgtactaagttgcctggctgttttctaatacatgttatttgaagattctcttgaaaattgcttatatcatgctgctatgttacaagaacatggttttcacgcattctggtatggaatgtgtatgttgctgtcacttatttaataataatagtcacaattaatcagtacaaatatttatggccctaagtaccctgagatctgttgcttgatacatgtctgaacattttggacaaaaagaggccagtgtgggacaatgagatagccttttaatagagagattcttttctcttaacaatgatctaggggttttcggggggaaacacacacccccttctccatcgggaccgaaactgctcttgtccgtgtgttctgtcacacgtagatgaacaggctttcaacacctgcactggattttataatgcattgggtttggttattgtcattattgtttttaccagtttatttattcattatggtgctagccacaaagcttatgcatgctgagcgtgggtttcaaattttgagtttttttgaaacattcaagacacggaagtgggcatcacaggtcatgagttctgttcgataatgatgtcactggtcacccatgttgcttttgacttggtaaaagaaaaattgtacttaggaaaagctgccctcatataatgtgtactcatatggtagttaaataagtccagtcaagggctgtaagacagccaatcagaatcttgtttctaaatgggcatgtttctaaactggtctatgatgtgctaatggacagaattttgcatttggaaaattgccatcacaaactcttgagccttccattcttaaaccagttgcaaggggctttaccaaactgacttatccaggttacagatataacaagttcctgtaggtaatggctctcatactagactgcaagtttttttttttttttttttttttttttgagacagagtctcactctgttgcccaggctggagtgcagtggcacaatctcagcccactgcaacctctgcctcccaggttcaagcaattctcctgtctcagcctcccaagtagctgagacagggactacaggtgcatgccaccgtgcctgactaatttttgcattttttttgtttttgtttttttagtagagatggggtttcaacctattggccaggctggtcttgaactcctgacctcaggtgatccggccgcctcagcctcccgaagtgctgtgattacaggcatgagccccctcgcccggcctcatacttcattgtttataagcgtgtactgggcacattgtgaaacacaaacgttctcccaccctgtccccagagactccagttcagagggtccaggaatctgcatttgacgtgcacacccgggggttctaaggctatttttgtaccatcattttgagaaatacatgaagctatttcaaacactcctcataatgtcaattagtcttctccttctgtcctaggaactagataattattatttcttttgtccaaaatcctttggattatacaaatgcattatatctggaggcagtaattaagctctggcctggcccacttttctccagataagtacactgattaccttcgcgtttccttacaggtccaactttccaacaaaatcatcactgtttgctttcctttaggcctacacgttcttttcctctgttacacaatgtctgaagtaaaacaaagatttctgtctttcctttcatgttgtacatgttgtgactaaaacacatgcctcaggtctcagtctatcttaaactgtggttatttctttaaaatccattttacctataagaacaataaaggcgtcttcaggctttttaaacctgtaacaatttaaagacattgggtcataaaataatgtttaacctggactgatacaattaaaataaaacattaacagtctgaattttgtttaagatagaaacttagccctcttgttcctggtatgtgcgacttcatgaaaacccaagtttcgctacttaaagtgcagactatgtttctatagtttcaggtagaaattatttggaaatgtaccatgctgctgtaaaacaaacaaaaagccaccctaagcccgtattttctccttttgtgacactgcagagttatagtttccacacagatatcgtgcctgcagggcctttagaagcatgtggctgctggctttcaccctgaaggtccagactgctggactcttcagccgccgcttcacccttccctctctgcttgctgctggctttggggttgggatctgcttcccactctcctgcatctgacgtgctcttccatttttctcccagtccatcatggtaaattcttgtcttcatattccttctcttctcccacctttgtttctgagctgctcacctgagctgtgggagtgcaactgggatcatcagcattttccaatcaaagtgctcttatcttctgatcagcaaaataacccatcacagaaatgactgaattaatgactctctagacagttgagtctcttccacgtttttgatcagggcctgctcatactcagacatttcttgtttgttgttgttgcttttatgttcatggctgttcccaagcagagagaatttattttattctatttttatttttattttttgagatggagtctcgctctggtcacccaggctaaagtgcagtggtgcaatctcggctcactgcaacctctgcctcccaggttctcaagcaattctcctgcctcagcctcccaagtagctgggattacaggcacacgcccttatgccccattactttttgtatttttagtagagatagtgtttcaccatgttggccaggctggtgttgaactcctgacctcaggtgatccacctgtctcagcctcccaaagtgctggaattacaggcatgagccaccattcctggctgagaatttcatttaaattgtggattactaggcattaattatgtttgtgtgagagagagtggcagagggacattgaaagagcaacagggacagagagacagagagagaacaaggagaaggaggacgagagagaaagaaagagggaggaatgggagggggtactgagagatcacaccaaattcattgcacgttcctgtgagttgctgccacacgctgcactgggccaacgctttcccaccagtttcactagtggagatgacctcatcggatcctctttgccatcttctgtgaggttggaaccatgcagagtcctgcattttcctccatctacccctaagtccttgtgttaattatgatctgtgttggcttttatcacctttgtggaaagagaagagccaccaataatgaagactgagtaaatgagccagtgaaacagagacggggatgtgcaccccccaggctcctggatgattattgacggacacgtgtcagctgctaaatgttatttaaaacttgttcttgccatcctatcatcatttgctgtcctcctgaatatggaaatacaatgattagaaggctgttttaccatcctgagatatgtgcaccattgattttgtaatttgttgctaccttctacttatagtaaatggtccatgatacataaaagaaatttatgtcagagcttttcacagtgaataaatattaggaagaaaatacatttagacaatagaaggaagcagtgtaatgggagatcctgcagtcatgtatgtgtcgtttattttctcccaatattttttatagtagctgtgtgaatatcttactttttacggtgctcaattccacattggcctgatatttgacatattttaaggcacagtgggagaaggaaccaatcctgacctttctctaggcacttttctgatgtcagtagatgaactgaataattaatatctgacttcttctggaacttatttgaggtggcttacagaatcctcccctggcttcctattgtgttttggataaaaggcaagaccagtggcacggtccacgaggctgggcctggttttctttgtgcctgtctgtccagcttcatctcggatgcttcacgcctcactcctgacatgtagccacacatgcaccaggttacaaccgctccattgcatgggaaacctgccccagctggtcaccacctccttcctgtatactcttcaactctcagctcaaattctcttcctcagagcacccttgcttgccccaacacctcagtaaaaatcagcacatgccccatcattatacgccctcttgacacatggaattcctgcccactgccccacctcacagtgtcactgggtttgcctgaggtctctcccaccgcgtgcaagtgtagggatgtctcttcagttcagcacgttaggccaatgctcactgtcacaacattggtatccagtacacgtggttaaccattgctattgtgaaatattataatgcaaaaactatggaacatgtaaactcacagcttaatgggtgagtgtaacctgaatttcctaatgtgaaatagcccattcaggtctagaaacagaggacagccagtaccccgcagctcctgtaccttgacttcctctttccagtggcaacttctctctccccgttgagttatgcagcatcctggatttcatggaaatgtctttctggcttgtcttcatgaacttacgtgtgaaccactcacttagtgtagtttgcccactgtggaactttttacaaaaagaaatattcatcttatattctttactgtctgatctatgtcacttaaaattatatttgtgaggttcattcatgctgtgcatgtagtcagaggttgtgatttgcatggctatatggcattctgttacatggaatacaccactctggtagacagaccaatgacaccccatgaagatgtccgtatcccattccctggtacctgtgactatgttagcttccctgacaaaggagactaaggttacaggtgaataaagatagtaagattactcatcaattgcctctctgcagccaatcatttctctgatgctatttgtttttccattatactggattatgtgaaaattctgatactaggctaatagctgtttaacatggatctaatgaatagattccattctaggccagctatagtttaaaaatactacagctttctttttgagtaatttgatacctaaaatagtgaagacctcaggaagagcccatcctctttgagacccgtgaacattctgccgtgccaactgtcttggctggcatttgcttccccttaaattagcttcctcctgtcacagaggggcccatactacaaggctggtggatgatgacaaatttgattcttgaaaatctgttaaggtaattgcaaaattccactcagtttccctgggaaaataactctacctgctagtagaatcaccagccttttcaaagaaaatgtatacatcaaattagcaaattagttattttaaaattgtaaaccaaaggccaggtgtggtggttcatgcctgtaattccagcactttgagaggctgaggtgggcggatcccttgagtccaggagttcaagatcagcctggccaacatggcgaaacccagtctctgctaaaaatacaaaaattagctggacacggtggtggacgcctgtaatccgtgttacttgggaggctgaggcagggagaaatgtttgaacccaggaggcagagattgtagtgagccaagatcacgccactgcactccagcctggatgacagtgagactccatctgaaaaaataacataaaaataaaataaaactaaattaaattgtaaaccaagagtgttgttggaatttccacctagtcttcgagtgtaagtgtagctagaatatgccgcagacacaggagcatacccctcaggaaccagggagcaggcgctggatgaagcatcaatgcttgctgtacattcggcttttgtttttgagtttcagaaacccactcaaattagtttaagtaaaatggaaaatgaaatatctcctaaaggctgggcactgtggcaaatgcctgtaatcccagaactttgggaggccaaggagggtggatcacaaggtcaggagatcgagaccatcctggctgacacggtgaaaccccgtctcgactaaaaaaatacaaaaaaattagccgggcgtggtggcgggagcctgtagtcccagctactcaggaggctgagtcaggagaacggcgtgaacccaggaggcggagcttgcagtgagtcgagatagcaccactgcactccagcctgggtgacagagtgagactccaactcaaaaaaaaaaaaaaaaaaaaaaaaaaaagaaaagaaaaaaagaaatatctcctaaagtaacaggagtgcattattaaatccaagggaaaaatgcatccaggcctcaggaggaaaagtacatcaaaaatggaaagccaagaggagctcattctgtctctttgagcttcttacctttttgcctttgtctctttgcttttcattctctttggttctgaacctctctacttcattcctctcattctgtaaatctgctttatttcctttggaatctttacaccatatggcagcaggcacttaacttccctccccaccttccgttctcatggtttgtgacagcagccaagaacgacttggaatattttaatctcacaccacaaatcctggagcagacttttgacctaggttaggccaattaattgtctctggctgaggaggagaggagggggctcacagactagaaatgtggcttccagggcccatgggtggaggaggagggcagctccgatcattctgactgggatgctcttcacaatgcctctgtaccgtgctggaacattgtaccagggtggcaagccctttttaaaaagtgagctccaattactttagtctctgccattcaattgctggtggttcttgcctttgaggctagtttgttagttacttaatatttattgagtgcctgcagggatttttgacattgagaagtgatgtgttgagcgtgccaaaaatctacccagtatagaaaactcatctcaaaatcgcctgtgggtttcagagagtctatgcaaaaacagccattatctaaacatgctttaagacgctgttatcatacacagcaaggtgaaagatacaaatgctcaattttaaattctgcagcttacttcatagccatcttttcactgaaagggatttctcttgggcctgatgtgttgtgacatttttttctgtggatgatcaggtcacagtgctgctgcttttggaaatatatagaacaacttgatacctttaaaacattatatcaaaatagaaccaaagtagactgagcccagaaagcaagactaacttacattttgaactaatttcataaaagaatctatcagacccagtcaattaaactgaagagcctaaaataatttgaacctgatgttggaatttgcaggtaaaaataatcaagaagaaatgttaacagatagctattgcatcaataatttgcctgtttgttttctagaaggattgatagggcagaagttaattctgaaaacacagttttgctgaccttcaagtagagggctgacagctgctttagcaagggtggtgggtaggatttcaaactgctgtgccctcaggcagcaacatcaagtcatgttatgtaaaataggcaacttcagaagttcccaaatgtatttgagaaaagtagggtggatcccaggtgagtccatgaggcgcatacggaaagggtgtgggagagccctgggagagcctgagcagtgagacgtcccttctccacatggaggacgtggtggacactgcccaggggaagaggggcacccgcaggtttgtgtctggatgtaccggaaacattggctcctctgcttccactaagatgatgatgatgatgtataattaattgccagtcctcgaaagttgggcaggttaaccaaaattaacttctaattaatgaaataaacggaggtgttggggaaggtgggatgacatcgtcttccaccaccaccacatcccattcccgcattggttgcttcagtctttctgaaagggctgctcagctgcccacgcctgcagtctctgcagttattcacatggaggcggcattaattcataccttgcggccatatccattatccctccctcacccccactactagcaaaagcaccccggaagtactcacaagaaacaaagtgacagtcacaaggaaaggagcatctcggggagtgggaaagcttcccctgctaagtacatgcaatgctttattggacgatgagttagggtcctcttgctccaacaagactggcttgcgtttccacctccagccagcattgtgaatcccaagtagctgctgatttatatgtatcctctggaattatttaaagctatcaattacctaaccatgggtatagttatatcgtagaaaaggccactttccattttgggagcgagacattgtcttctagtcttaatatacttctgcaggctgcctgatagaagaagagattgattggtttaaagatagattgttatgagagaaataatttacttcacttcctccttccctagtgagaaggccatctggttgacccctctgcctttagctaagggacatagaatgcacaattgccagctgtccccaatgtggctggcaaggctggacctcagctgtccccggggtccctgctgtgctgcccccgattgctccagtcttctcctgcaggggtgtgtctttaggaggaggctttggttgatcgtgaaatcatcctccaatctcacttctgctggaggtgactccttctgtccctttagctgcgtaaggccagacttacattacatgaaacaaacacgtcatgggatgtgtacccggaacattcacagtggttattggctgcttgaggtatgcatcactttactgtggagtcacaattatggatccaataacctggatcactctgctttgaggacccaaaacaaattaaatttctgatttcccctcattaaagctcaggatgcaacaagaagttggaggatcacaagtggaatgtgaccactctagccccttccctttctttataaagagtaggaaatgcaatgcactttcgagttctttctctattacatatcatatgttgctaaaacattacttggtggtgatagcaataaatagtaaattagtatcttgtgtttctataatttttataaattatagtgtgctttcaaatacatttacatttaatcctgataacacctatgcaatcagttccttttgtgtcccactcctttcctccttgcagcgttcaaaaatcgtctccaacttagagttctcatttgaatcttctcctcttcataaggcacaaagtctgataaaggtagcaagcaaggcaaatccatgagagatacgaagctcaggccaagatgagacgtgtcagattttaacagagaggagagaacagggatgcataacctgacagagaggcgtgggctctatcagctgtagctggggagaaaattaaagcggcctgcattagggtcctccttgaatcagttcatagacattgtggtgtctacaattattatcttaatctgggtttcttgcactcgagatacaaaattggcacacacaaaagtcaagctgtaatcacaagttactaagataataacattggataaaggtgaattttatgtttaaaatgaccaaacgactcagaaaaggtatagcttggttttagttcgttgtttgttttatttttgcctgagttaaaaataagtatgagcagcagtgatgtcgcaaaggacaggattgccaactatgcgtgtcagtttgcattacatcttgcagaatccattgctgcttatggcctcattcacgcaactgggcttgcattaaccctttgctttctgcatccatcaatgattgcctttctgttacttctaaaggcatttatccatccattcatccactcaacacagtctctgtgcactatgttgtcccaagttttgtacgagacattgagacgttgaacacagtaaggtaactgtgtccttaagtagtttgcccccctggtaatgacacatgcattatgataatatattaatactcatactaagataatatatattaaagagataaattaatagtggaacagtgttacagaaaggcactcacagagtgttgtgattgtgtccagggggaaagaataatgccggtgaaaccaggcaagacttcctacgatgtcagaggtgatattttagctgataagtaaagaatgcaaagggatttgcctggcaaaatgaagatgaagggaaattccaggaaacagaaaagttgtagggcgtgttgaggaaaggggacatggaagggaatgacttgctccaggaacaatagggtatgagcggagtagggtagaacttagatttggcctagaggtagaaagaggacagacttgccatgtcacaggggcaaagggtgtttttttcttgaaaacagaaggctagagccccagagagggctttacatgcaaaagggatacataaatatatcccgacacctaggtctgtatgaccttctcagaataacactgttggctaatatctttctattgtatgcccagaattcagctacttcccagcatacccaccactgccacccaggacagacctccattacccctgtgccttgttggccgctcctgttcccaccctggtttctgcaagtgtttcctctaagcagctcccctggccaccttccttagtgggagccttatttacacactgctgtgctcacacccctttcactcagaggtaagccgaagcctgcacctggccctcaggctctgcactccctggccccttactgcccccactcctcagaacagtcaccttgctctcccactctggccactgcctccttgctgtctccactgaagcctatgctgtctcacaggccaggcacctgccactccctctgtctggattgtcttctcggatgtcagctctgcagattccttcagttctattcagatgtcactttgctagagatctctctgatgcaaacagctcccagagctccattgtcctgcttttctcttctcttagtgagctgatctgcttattgtttgtcccttcccccattcctgcactagattacaagaaaaaaaatgaaaaaaaaaatgaaagccattcaacttctgttgataacagtgtcagtatctgttttattcattcttgtattcaaggttctcaaaacctaacctggcatagtaagccctagataaacatgtgttggatggatggatgtggattgacagatacatggatggatggatggatggatggatggatggatgagtgaatggatggacggatgtggatgaatagatggatggatggatgagtggatggatgggtgaatggatggatggatatgtcgatgaatgtggatggatggatggatgtggatgaatagatggatggatggatgagtggatggatgggtgaatggatggatggatacgtcgacgaatgtggatggatggatggatgtggatcactgggtagaaaacttattcttcttagagcaaatggttaattgtgaacatgcttttccattttaatggatctccaaagtatgcatgtggtaacggaatagggaatatgttatagcctcactttcaccatgctaggcaaaaaatgtctcattctactgagaaatgcactactgacactcagtgtgccgggggacaacctagtgacttctcttgactttcatggaaagcagaatcaatcctactcgaattttcaacagttcaactcctgcaagttaggaggaagtctgaatgtggggagccaaattagatgttcaaagaagcacatattagcttgcattctaacttgaaaactgcatctatgctgtggttgtacccatttaaaaattaaatgtgcatatagaccagaaatagaaaacaatatgaaaaaggcttggccaggcgcggtggctcacgcctgtaatcccagcactttgggaggccgaggcgggcggatcgcaaggtcaggagattaagaccattctggctaacatggtgaaaccctgtctctactaaatagacaaaaaaaaaaaaaattagccaggtgtgattgtgggcgcctgtggtcccagctactctggaggctgaggcaggagaatggcgtgaacctgggaggcagagcttgcagtgagccgagatcgcaccactgtactccagcctgggctggaaaaaaataaaaataattaaaaatgaaatagaaacaatactcaaaagatatcaattatttgagctaatgaagataacattaattttatcattctggttcatgaataagatttggtcttgatgttctgtttttaatggtttccttggaatttcatcttaacagcgtttgaggaatgtcaactgggctgtgagaaattgcgtgcactaggttgcttgtatgaatagtaccactgaaagattcctgctagtcacagacttgatgaaaagggcttattttctttctgaattcaggtgaaatgaaaagctgctgaattagcaagatctaattacttatccttggccctggccagtgattttctcccaaagaaaatactacctaataggaaatgagattgaatcagtgtaactttctgtagctgttttgttgctcacggatagtcttactttttaagttctaaaaagctactctctgtagatgaattaagttatagatggcaaatatgaagacttgtagaaattctaaaccactgtagaactctttcctactaagcctataatggccccatgaatttttcttaatttaataacaaatatagccaatattaaatattttggatgatattgcatattgtctattttagtttgtagcaatttgacacattctaaagaacttttaatctttgatgaaaatatatttatgtattgcattgtctactttttaaggccgtcttcattctacctcattttggcttggttactaagttgcagttatgtgcactataagagtgtattctccagactatacatggacagaagtggtccctttgcagtgtgaccatctgtccttatttgttcctgtataattaataataatccatgtgtaactattatatttattacttattatcaagcattcatatgatcctttttgtctctcaaagaatcacagtttcgactaaaagttatatgattcctctaatttgcacggaactgaaaacttggtctcagcagccagtacgcgtgatgaatttcctagacttatgtagtctttagcaccctttagcagtgtctccagagtccctctctcacctgccactcttgctgcagtgcaagagggttctctggaagggactgaaacctagaataaggataggtgagttgcccagtgaagagagaccaggaaaatcttgaaaccttgaatgaggagctatggaaaaaagaaaagcctgaaggcagtgcgatgggcagaagttggtgaaaattggcacatagcatgtgctaaataaatatttaaatttggtaccctgaaatagaagttgatcacatggatgtaaaaaaaaaaaaagggaatgatgacagaggacttggagctgaaaagtttaatcctagttgggttggattcaatgagggtaaggaatttagctgtgaagaaggaaagctccaagatgaccctatactgcagagtctggtttattgggaggaggagcattaggtttgcacaaaagctgcaaacataataatatcagattctttcttgaggtaacatttggccatagtacaggaaaatgacagccgaaggctttgggccactgaaggcagaagggtgcagaagggtacaaaagggaactaatagtagcttcaagaatgggaagatgcctctttcactgttttgtatcttggttcttgatttaaatgaaatatgtctatttggcttattttatttccttatttcactcactggggttttctttgttgttgctgtttttaggagctggtggggagtaaccctccgcagaggaattggaaaggaatagcaattgcactgcttgtcattctggtcatctgctccttgatcgtcacctcggtcatacttctgacaccaggtactgtattcattcttggaaaagcaagtcgctgtcagagagaaagagcataattttaccttgcaatttttttctaagtaactacctattacataatttatttttcccaagttctaattctcactatgccatatgatataatatggtttcaattttaaaaattcattttatatgttttggatttgttcacaaagttgtttactacgtggaaatgcttggcatatattaaaattacttatacaatcacttattcatgcttgatcaacttaaagacagtggcataaatataatgattttatatatttcatagaattcctggacattatatcaagggtgaattaagaaaattattaaaacaacatatgttgagtgtgaactaaggagaaggtgctaaataggtactactgaatattacataaagtataaaccagtgtcataaatctctcaggaaagaaaagacactaaaatccacagaagaaacctacaacaaatacagatatatacatgcactattgagtaagccaaagagaagtgctattggagttgagaggagaaagagaaatctttcaaaagaaagttcatggagaaggtagtacgtaaagtgggcttaatggagtaatggtaggaatttagtagccagagagtggtaggattagggagagaagaaagcctttgcctataaaataataatatagagctggacatggtggcttatgcctgtaatcccagtactttgggggactgaggcgggtagatcgcctgacatcaggagttcgagaccatcctggccaacagggtgaaacctcgtctctactaaaaatacaaaaattagccaggcgtggtggcaagtgcctgtaatcccagctactcaggaggctgagacaggagaatcgcttgaacctgggaggcagaggttgcagtgagccatgattgcgccattgcactccagcctgggcaacagagcaagactccaactaaaaaataataatgataatataggagttatcatagaaaaacattgtggccatagataaaacagtatgtaactgttttatccgttctcatgatcatagtagatgcctatttgtgcaggcaaaaaagttttaattctcagtaaatacatacacaagcattagaccttaagatgaaaaaaagtagatattataatataaaacctttttccacaggtacaacaaatgtgggcaaattataatccaggcttaaactattaccccaaaatctaaatgagaaaaggacgatctgtaccctgataccaaactagataaagatatcacaaggaaacaacatgccaataccccttatgaaaatagatataaaactcttcaacaaaatagtagcaaactgaatctaactacatgtagaaagattatacaccatgaccaaataggatatattccaggaaaaacaaattggcttgtatgaaaatcaatcaatgtattatacctacattaatagaataaagggcaaaaagcacatgatcatctgaacagacacagaataagcatgtgacaaaatccaaaaaccatttcctgacaaaagactcaacaagctaggaacaggaagaaacatcttcaacttgacaagtatctgtgaaaaacccaatagctagcatcatactgaagagcagaagactgaaatcagtccgcctaagaccaggagatggtagacaaggatgttcattcccagcatggctatttaacattatattggagggtctagccagggctattaggtaggaaaaacaaaaacaaaaacaaggacaaccagataggaaagaaagaagtaaacctgtctctattcatagaagacataatgttgtatatagaaaatcttaaggaatccacaaaaaaacctattataataataaatgagttcagcaggaaggaagatttcagaccaaaatgcaaaaatcatttgcatttttagccactagctatgaacaatcccaaaataaaattaagaaaatgattccacttaaaatagtttcaaacggaataagatacttaagaataaatttaacaaaataaagaagtataagacttgtgtactaaaactacaaaacaaaatggaaagaaattaagacctaagtaaatggaagtatatcttatatgaattgattgaaagacttcatatcattaacatgacaatactccctaaactgatgtgcagattcaaccaaatctctatcaaaatccctctttctttcttaaagaaactacaagttgattctgaaattcatatgaaaatgcaaaggactcataatagtcaaaacaatctcaaaaaacaattcaaagacttatacctcctgattttaaaacttactgtaaagctacagaaatcaaaacaatatggtactaggataggtatagacatatggatcaatggaatagaattgagagttcaaaaataaacccatacatctatagtcaattattttttgacaagggagtcaagaccattcaatgaggaaagaatagtctttccaccaaatggtggtggtacaactagatattcacctgcaaaagagtgcagttggacccccaactcgtaccatatacaaagatgaactcaatgtggaccaaagacccaaaatataagagctaaagctataaaacttttagaagaaaacatagggataaatctttgtgactttgaattaggcaatggtttcttacatgtgacaacaaaagtgcaagcaatcaaataaaaaatagataaattggacttcatcaaacttaaaacattttgtgtatcaaaaacactatcaagaaagtgaaaagacaacccaccgaatgggagaaaatatttgcaaatcaggtatctagtaaaggtctagtatctagaatatatcaacaactcttgcttctcaaaacaaacaaacaaaaaaacaaataattcaatttaaaaataggcaaaggatttaaagagacatttctccaaagaaagacaaatggccaaaaagcatatgaaaagatgctcaacatcattcagcctcagggtgaatgaaaatcaaatcacaatgaaataccacttcacatccactaggatgattataagaaccaaacacaaacaaaaaatggaaaatagtaagtattcccaggatatagagaaatgggaaccttcttacattactagtagaaagataaattgtgtggcctctgtggaaaatagttcagtagttctcctaaaagttaaacacagagttaccatattacctagtaattctactcctaggtatagactcacgaaaactggaaacatatgttcatatagaaactagtacatgaggttcataacagcattaatgataatagccaaaaaagtgaaaacaacccaaatatctatttcccagagaatggataaataaatgtgatgtggcggggcgcggtggctcacacccataatcccagcactttgggaggccaaggagggtggatcatgaggtcaggaagccgagaccatactggctaacacattgaaaccccatctctactaaaaataaaaaaaaactagccaggagtggtaacacatgcctgtagtcccagctacttgggaggctgaggcaggagaatcacttgaacgtgggatggtggaggttgcagtgagttgagatcgtgccattgcattccagcctgggtgacagagctagactccatctctaaataaataaataaataaataaataaataaataaataaataaataaatgtgatgtaaccatacaatggaatactcctccactgtaaaaaggaatgaagagctgatccatgctgtaacatgaattaaccctggaaacttcacactaagtgaaggaaggctggcataaaaggccacatattgtatgatttcagaataggcagatccctagagataggaaatagatttgtggctgctgtaaggtagaggtagggagaaaatgaaatgattgctaataggtatgaaatttctttgaagggggatgaagaaattattctggaatttgatagtggtgatacatgtatgactctgttaatattatatattttaaaaacactgaattgtatacattaaaaagatgaactttatgatatgtgaatttcatctctattaagctatgagtttgataaaaagatgggaaagctgttgggggagaaaagtgtaacctggccacaaaagtgccagacatactaaattgccttaaaaacttgtgtaactccaaagaggcttcaggagcagttccgggagagagagcgttgcagtctcctgcgtgagcgagcttcgtgaatggagcacagttgcctggaacaatcaggctgaggattcaatccagtgcttcaatgcccaggaaacagatccctgcacctgctgaaatcagatgaccagggtttagaggggctgggggaggaactgcaaagccaatccttgttttgttttatggtggtggtgctgatgatctcacacagctggggactttaaccactacatatttctaacgaatatagaggaagtcaagttttcctcagggtctgtggagcatgtgtttctgcctctacttttctttgagcagaattgtgctttgtgtaagaacatgattactgcagattcgatcttgtggttgtctggcactccctttgggacttgaaagcagtggtgtctaggggtttgcagttactcccaccttccaaggtgcatgtgaactttcatgtcaccccggtccaagggctgtcacgagtgtcactcaagagtggaataaggccggtgtggtggctcatgcctgtaatcccagcactttaggagggcgaggtgggcagatcacgaggtcaggagatcgagaccagcctggccaacacagtgaaaccccatctctactaaaaatacaaaaattagctgggcttggtggcaggtgcctgtaatctcagctactcaggaggctgagcaggagaatggcttgaacccaggaggcagaggttgcagtgagccgagatcgcgccactgcactccagcctggcaacagagcaagagcctgtctcaccaaaaaaaaaaaaaaaaaaagtggaattaaatggctgcccggagcttcttacaccgaaatgtccacagcagcaaagcgggttgagaaccaggtcctgggaccctgtcctccaagctcaactccaggcctggcaagcagtagccctgcgtcttctccacgcacagggagtggcggcaggcctcctccctccagcacagcagctgaccctgccagcatctacattcagttcttttgcagccaaggcaaccacagcagcctcccctctgcagtaaacagaggatgcagttgctgggaactcttctccctccatgctgacggccagttgtcaggggcaactgctcctggagaagctctagtgaatggctgaattccagagaaggctttggaggggaatttgcttttcttgttccatcacaatacacatgcagctgagccttgcttcaccttttggttctgctgggctttcatgggtgctgtttgtttctctgggctgtgctgccctgggatggggtgtccaaggtttaggcctctcccacagggctgcacagcaaatgttgcaccgctgctcccgcaccgaggcctgactgcatccactctcctgcaatacagcaatggcttgtgttttggcataaaattccatcaggcagaggaggtatcaaatcattcaacctgccactagctccagagcagtgtcaaattcactaatgtacagagcagtgtcacctcgacagagaatgcctgccaacagagccagcatgaatgatcccggctaggagctgagaactccatgctaagtgccagacagaatgtggaaagagaagatgccagtacttcccatgaagcttagagtccacgtaaagacaatgcatgtgcaaggagaattccacagtagtgttatcattaagtaaaaataaaagtcaaaggcagggtgtggtggaggcctgttgagttgtgtagatagtggaaatgctgacctagagggctgagatcctcgccaaggcaggagtggcttccaccggtgaaagtgaaagatgacagtcagtcttcaacagtggagaatccaagtcgtaaccgtcacacttcgcatatgtttgcacacagtgttgagtgcgttcctacccaacattgcttccattttggtagatttagttagaaattgtaatatgtgcttttttaaaaaaatagtatttttcaagtactaccagtcttgtattctggtttattgcaactcagagtacagtatctgctttctacttaattagaaaatccattctgaactcacttgattcagtcgttttgtgaaagtggttcctggtacccaggggccccttgccacccctgtgagaagaatctcatgcgcatggtggagtgccctcctgatgacgcagacctggaagggcctcatggtaatcactctgaacaacaaggcatcttgtcctggagtacagtctaattatcaccagttatgcacaattgatgttttagaaatcaaattaaaagtgttcaaggtgatcttagttccaaagggatttaccaagtgagaatatgtccctttcaatgttgtcattcatatctcccttgctggtccatgctcttttctaaatttcttctctttggaataataggctcaacgttacattttttattttcaatattaaatatgtatctgtctacaataggccatgcacagcgtatgccttttgttagcagctacagttcccgcattctgatggaaacaccgtgaccttctccggtgccacaatcgctgacgtgggggtcggaaactccagcaggatcggatttgcatgaaaacatccctgacaattggcttttatggaatctcacattagagcaggtggacagtggtttatgccggaaacactagaacacttttaggtggtacatcaatgagaagccttgaataattcaaagtcatagtgaatggaggttctgggttaaggccaagcacaggttatcagaacacaagactcgtcagtcttttgggtagaaacgtaacatagagattacttttacggaattaaaatgtcatcactgtttaatgtctgtgaccgcattgccaaccctcaccttatctttttaaaattcttgaacaaataatttcaaaacattttattgaagaaggatatacatataggatatatattatatatttaacataaatattatatagatattaaatatataaatataaacacatgtgagtaagctattgttgaattttgatgaattttaaaaccaaacttgattctgtaatcagcatccaggccaaaaaagcagaatgcagccagcatccggaaagccccccaggcccttcctatcattaatcctctcaagggcaacctcatttctgacatcacagagtagtattatgagtttttatattctttgcatttatggcataaatgtaatcatctggtatgtctacttttatgcctgcttttgttctatatgtttgtgagattcatagttgtattttagattgtactgctacccaatttttaacctatattggattatcttatcataaagtcccacataatctcaatgaaaattgcaaaatagcttaacagtcatttaatagcttttgtgtgtatcataaaaagtaatgcatacctcctaatttttttttgtcttgtagaaatagatggcttgctccgtatcttttgggcattttctctctgttagggctcctatattaaattcattccacaaattcaatcttgttatattccatctactaacactgaccatggcccaacccatttcatcatgggaagcacaggtggcttgagtgggttctggtattgttcatttgccctggggcatctgctctgtgagtcctgggctcctccgtgcctgctcacacccatctgcagcggactgactggattggggatggtgtctactctgatcatgaaacacagagttgttttggctgctgccgatgctaccactgttaatgtttctgcccaaagttaacttgttaatactaatcgagactgggtgctataaatagaggctgcagatgatattcattatgatggtccaaaacatgggagaggccattgagaacaggatacattcctggaaggcttcgtggagaatgagcaattagggactttaaaagatagatccagtagagatggaagaaaactgagagggaaagccatgagccctcgggggacagaggacagtctggccaggaagttgtggaggggccaggtgtggtcaagagttaagggagaaggaaagggatggtagccaatggggagagcctggagcgcacagggcctggatttgagactgaactctaacttctcataccgtttacaccagtgtcctaaccagtttcagaatctgatgaaaactgtaagtcatcttatcgttggaaggaaagaaagggcattgtgtgcacataaacatttggatatgttgtattaatataacgtttgcaaacctagtcagtccatcccagggccatctcagggatctgcttgagcgtttatccaaggtccaggtgttaaagtttgtcagccaaaatatttttgtctgtgagtaacagaacagccaactaaaactgttccaattgcaggtgtccgtattgtttcacaagacaagtttagacatagccagtccaaggcagattcagtgctcgtggatattgtcaaagtccaggtgggctccatctctctgctgccatcagtatgtcgacaacatggttgtgacggcttcatgcttcactcgcccacacgcacaggaagggatggacacatagaacttagcttgtgcatctcacttcctctgtcatggaggaaatagttttctgagtagttcctttcggttccccggagctgcgaggagacagcttatttgctgtaaccatattgcatggctaccttcactggagggggttggcaaagcccgccatttgtaggagtcaggctctgctgagtcagaagaaggcagagaggcactggctcttggggaagcagccttcagtgtccaccaccacgagcaagaccccttgatttgtgaaatccttgaggaatgtggtctacattccttgaacatgaccagtgaatttgagtcattctttaaattgaaacaaatcttctccctccaaaaggagggagttctgacagattctcatagaagaaataattaggttacattgctactaaccctatagtgagttgcaaacttgcaaactactgaaaagtgggtcgctgggaccatcttaaccgtctctcttttgatttcccatcattaattctagaaggactactaggtgcatctcgcttatttatggagtccttacactaaagagccatttttctaaaggatggcagtagatgcttattattcacactcgtgttaagactataagctaaggcaaatgggtctacatatttatctataaatggacacttttcaagtgttgctgcattttgcatcctattttaaaggcaaccatgaaaatgagtaaatcttatgctgggaccctggtttcctctggagtctcttgcctgctatagatgagtgcctcctggtcagcttcaaattaattttggtggccttaaggaccatatttttacaagcagctggctcctatattagttgctagtttagtgaagactctggcagtccagaaccaaaggcagcaattcaggagtttaagcagagttaccataccatgtcagggtcaggaacacagaaagctgtgatataataaaatcggagaactggagagcaattctgtaaaatgaactaagcaggtcggggaactaggaagatgaaattccagattgaaatggttccaaattctctgaactcttcaccttaagccctgcttggacaaccattgatcacttctgcagaaacagtatatccatgcactttctcagattgctacttcataatcctcaaatcccagatattctaaattgactctgtgcatttaagtatggtattaaaatcaccagaagttcagttaagtgataatttgcaggacctcccatttaatcagtctctttcttgcttttcccctactcagattcttcatgtctttctttttcattcagtaaatgtatgatcattgcagcctcagaggatgccttctaaagtggtgggttggttggaaatgggagaaaggccttgaaggatgcggtaggctaaaaaatgcgccccccccaccaaaaaaaaagtccaagttgtaatccttggatcctgttaatgttttcttttatggccaaaagggggccttttgtggctacattaagcatctgaaatggaggattacccttagttatccaatggaacctcaatgtgatcacatgtgttcttataagaaggaaataagaatgcttgtgatttttgtacattgattttgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaagtgggcgaaggacatgaacagacacttctcaaaagaagacatttatgcagccaaaaaacacatgaagaaatgctcatcatcactggccatcagagaaatgcaaatcaaaaccactatgagatatcatctcacaccagttagaatggcaatcattaaaaagtcaggaaacaacaggtgctggagaggatgcggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatatcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggtcgggggaggggggagggatagcattgggagatatacctaatgctagatgacacattagtgggtgcagcgcaccagcatggcacatgtatacatatgtaactagcctgcacaatgtgcacatgtaccctaaaacttagagtataataaaaaaaaaaaaaaagaaggaaatagagggagatttgacacagacgaaggaggaaatggcaaagtgaccacagaggtggagatgggagggatgtggccacaagcccaggaatactggcagcccccagaggctggaagagacaaagaacagatgtgatatggcttggctgtatcctcacccaaatctcatcttgaattgtagctcccataattcccatatgtcatgggagggacccagtgggaggtaattgaatcatgggggtgggttttttgtgctattctcatgatagtgaataagtctcatgagacctgatggttttataaaaggcagttcccctgcacatgccctcttgcctgctgccatgtaagatgtgcctttgctcctcctttgccttccaccatgattgtgaggcctccccagccatgtggaactgtgagctcattaaacctctttttctttataaattacccagtctcaggtatttcttcatagcagtatgaaaatggactaatacaagatgcttccccagaacctccaagagcgtgcagccctgctgacacttgtatttgggcccagtgaagctgattttagacttccagtctccagaactgggagagcatactcttctgttgtttgaagccatcaagtttgtggtcatttgtcacagcagccacaggaggctaaaataaagggagataaatggcattgccacttttacggtggccatgtcttacaggcaggcaaaagaatgcacttgtggagagatcagaactagaatgcttagaagccatgtgccagcccttggaagaccatgaactggacaacaactgtgccacgcactgccctgtctgctccttcctgccattcacaatgggagtccatgctgggctcctagctcagctctctaggggacaaccctgagtttcaaaaggtggttctttaccatcttcaccacaaagaaaggaaatgaaattctttcaaattgagatgtattttgatgtttttcaaaatttgagagaaagaggaaggaagaggagaggaagaggaataggaatctccagtattgacttaattcttcttattttacatacattcaattaaacagatttaagctccacttacagtctatgttattaaatttgtcgagatgggagatgaaatgcagattaaaaaaaagaagccaatgaaattcagattaaaaatatacattgtatgtgacagataatgataatttctgagactaagtaaccccttacaatgtgtaaaggtgtttgctacgtgtcacaggtattttgggtttagcatgcctattctcgtaggcatcgggtgaagaattgttccacccattatttccctattgggagcacactacacctgtgtttacacagcaagccagtcatttgggaaggttaaattattaatagctgaccttggtgttggtacatcatgaagacacataccgattcaggctctcaattcaggtatgagtatatgtttatgatcagaacatgattttattaattttattgaacaagtaatatgtataaatagaaaaacagtagaaatatattaaattggctgggcatggtggctcatcctgtaatctcagcactttgggaggccgaggcaggcagatcacctgaggtcaggtgtttgagaccaccctggtctccgtatctgctaaaaatacaaaaattagacaggcgtcatggcgcgtgcctgtaatcccagctacttgggaggctgaggcaggagaattgcttgaatccgggaggctgagccgagatcataccactgcactccagcctgggtgacagagtgagattccatctcaaaaaaaaaaaaaaaaaaagaaaagaaaaagaaaagaaaagaaatattaaatgaacaataataatccttttataattattttctcatactgtcagttctacaaccagtccctagatactgtcactttccaccatttctgatttaagtcttctgatatttattcatgtgctttttttttttttttttttttttttgagacagagtctcattctgtcatccaggctggagtgcaatggcatgatcctagctcaccacaacctctgcctcctggattcaagtgattctcctgcctcagcctcccaggtagctggtattacagacgtgtaccaccacacctggctaacttttgtatttttaatagagacggggtttcgcgatgttggccaggctagtcttgaactcctgacctcaggtgatccacccgccttggcctcccaaagtgctgggattataggcatgagccaccgtgcctggccttattcatgtactttttaatatcatgctgatatgtcaatgtccacagactaccgactacgaaggtcaaaatttagctgctttacattttctcccacttccgtctcttcactctgagttacaaaacctataatgctatttcaagtcctctatagatgtgtttcataaccacgtgggaaaattttttcatgtataaatttcttgttccattgattctaaatgcgcctcttgacttgtcactagataatatgggaaagaagcatgcttaaaagactttcttctcaatcccagcttcctactctttctcttccctttaagtaatatttgcaatatttttttcactttaataaaatctctcatcaaataataagttggtttttaaaatcaaaaacacatttacaacattcactatttcattttttaatttttaatttctgtgggtacatagtaggtatgtatatttatgggacacatgacacattttgatacaggcatgcatgaaatgataaacacaccagggtaaatagagtatccatccccttaagcatttgtcctttctttgtgttgcaaacaatccaattatactcttttagttatttaaaaatgcataataaagtattattgactgtagtcacattgttatgctatcaaatagtaaatcttactctttctaactctatttttgtacccattaaccatccccctctgcccacccccaccatccaccactacccttcccaacctctgataaccatttttctactccctagctccatgaattgtttaatttttggctcccacaaataaatgagaacatgccaagtatgtctttctgtgccaagtttgtctttcttagattatttcacttaacataatgacctccagtttcattcatgttgttgcaaatgacaaatctcattcatttttttgtggctgaatagtactccattgtgtatacgtaccatattttctttatccattcatctgttgatggacactagggttgcttccaaatcttgggtattgtaaacaggtctgcaactaacaaaggagtgcaggtgtctgtttgatacactgatttcctttcttttgggtacatacctagcactgggattactggatcatatggtaactctgtttttagttttctgaggaacttccaaactcttctccatggtggttgtactaatttgcatttttatcaacagtgtatgagggtttccttttctgcatatcattgtcagcatttgttattgaatgtcttttggatatgagcctttttaactggggtgagatggtgtctcattatagctttgatttgcatttttctgatgatcaatgatgttgagcaccttttcatatacctgtttaccatttgtatgtcttcttttgagaaatgtctactcagatcttttgcccatttttaattggattattagatgttttcctatagagttgtttgagctccatatatattctgcttgttaatcccttgtcagatggatagtttgcaaatatttactccattctgtgggttgtcttttaactttgttgattgtttcctttgctgtgcattttaactcaatgtgattccaattgtccatttttgctttggttgcctttgctaaatagggtattactcaagaaatttttacctagtacagtgtcctggagagtttccccaatttttttttaagtagtttcattgtttgaggtcttacatgtagtcctttaatccattttgatttgatttttgtatatggtgagagggaagggtctagttttattctcctgcatatggatatccagttttcccttcaacatttattgaagagactgtcctttccccaatatatgttcttggcaattttgctgaagatgagttcactgtaggtatatggatttgtttctaggttctctattctgttccattgctctatgtgtctgtttttatgccagtaccatgctgtttggattactatagttctgtagtataatttgaagtcagataatatgattcatccagttttgttcattttacttagaataactttggttattgtggatcttttgtgattccatgtaaattttaggatagttatttctatttttgtgaagaatgtcatcagtattttgatagagatttcattgaacctgtagactgctttagatagtatggaaattttaacaatattgattcttataatccattaacatagaatatatttttattttttatgtctgcttccatttctttcatcaatcttttatagttttcattgtagagatcttttacttctttagtaaggttaattcctgggtattttattttatttgcagtgattataaattgaattactttctttttttaaattttattattattatactttaagttttagggtacatgtgcacaacgtgcaggtttgttacatatgtatacatgtgccatgctggtgtgttgcacccatcaacccgtcatttagcattaggtatatctcctaacgctatccctcccccctccccccaccccacaacagtccccggtgtgtgatgttccccttcctgtgtccatgtgctctcattgttcaattcccacctatgagtgttttcagattgttcactgctggcatatagaaatactactgatttttgtaggttgatttttgtaacctgcaactttgctgaatttttttatcagttctaattttttttagtgaaatccttaggtttttccaaatataagatcatattatctgcaaacaaggataatatgggcaggtcgagaaatatcatccaagaaccaaggcctagaattggggaccccaagagcccacttagtaccctgccgctttgtggctgagctggtacctaagttgcaacacaaagtgctttttacctttacttctccttttcttttttttttttttttttttttttttttttgagacggagtctcgctctgtcgcccaggctggagtgcagtggcacgatctcgactcactgcaagctccgcctcccgggttcacgccattctcctgcctcagcctcccgtgtagctgggactacaggcgcgcgccaccacgcccggctaattttttgtgtttttagtagagacggggtttcaccgtgttagccaggatggtctcgatctcctgacctcgtgatccgcccgtctcggcctcccaaagtgctgggattacaggcgtgagccaccgcgcccagcctacttctccttttcttaagcagaagaagtctctccctgtagccccacagctgggaatgtcctgggtcacacctgaagccagcctgtctctgagtcttacccaagaccctgagcaagtactgcctgagtaccactgctactgattatttagggcccaagggctccttagtcagcaggtgaggaatcctgccagattgggtttttccattcaaggcaggcacagggtatgtttagaaatgtcatcccagagctaggacctggaatgagggcctcatgactcttcctggtgctctattctactgtggctgagctggtatccaagttgcaagacaatttcctcttttctcttccctctcctctcctcaagcagagggaaagagtctctcctagagctgcaagctgtgctgccttgggtttgtgaagaggtgatgcaagcactcccttggccaccccagctgctgtctcactaggttgtgtgtcccccaagtgtactggctctgagccaagaacagcaccaagacttgcgcaggaattgcagttcttgcggcctagactgcctttcaagttattttaggaccccagaccactttagcccacagtggtgaggcttgctggagctcaggttcccactgctgggatatgcagttcccgaatggctagggctggtctcagtgctccgtccgtgggaattgactgagttctgcctagcgttgctttactctgtgacaaagcaacactgagtttcaatgcaaagtcccacagtcactgcattctccctgccccaagcaagcagattctctgccacacaactgctgccaggggatgaggaaggggaaactcaagactgtctttcccactctcttcagtgctacttcagtgatatgaagtcaaaaccagatactgtgatcattaatctgatttttggttctttacgagctgctttttcctgtgaatagttgttcaattggtgttcctatagagaggatgatcagtgaaggcttttatttggccatcttgctctgcctcctttcaaaattcacaattttatacttaaacaaatatttctgttgtaaatctgaagccatagagagaggaaaaaatatataatcctgtgtaactgaacaacttttcttgaggcattccagtcaagtggacttttcttaaaattcattaatagttacaattggtctattgatattgggaccatgacttacttaaataaattgggttttctcaataattttattggattatttctacttgaaataaactgtccttgttacagacaaaatgaatgcctgcacaaaatatgccaaaataatatatgtatagtagttccccttatctacagagtatccattccaagaaccccagtggatgcctgaaaccatggatagtgctgaatcctacttatactatggggttttattgcacatgtatacctacgataaaatttaacttataaattaggtgcagtcagaaattaataatgataactagaaataaaggagaaaaattataccaatatactgtaacaaaagttacatgaatgtgttatctctcactctctttcaaaataatctcaatatttctagaccatggtcaactgatggtaactgaaactgtggaaagcaaaaccatgggtaaggaggggcctactgtaagtaagtttagaaaggttacagaatgcaaggtctatttacacatattaattgcatttctatgtactagcaacacacagttgaaaaatttttgaaaatacaaattttattagtcagcttgagctgtcaacaaaatatgcagactgggtgatttagaaaacagaaatgcaacaaaagccaaaattggcaagtgggatctaattaaactaaagagcttctgcacaacaaaagaaactatcttcaagagtgaacaggcaacctacagaatgggagaaaatttttgcaatctatccatctgacaaagggctaatatccagaacctacaaaaaacttaaacaaatttacaagaaaaaaacaactctatcaaaaagtgggcaaaggatatgaacagacacttttcaaaagaagacatttatgtgaccaagaaacatatgaaaaaaagttcatcatcacaggtcattaaagaaatgcaaatcaaaaccacaatgagatactatctcactgcagttagaatgatgattattaaaaagtcaggaaacaacagattctggagaggatgtggagaaataggaacacttttgcactgttggtgggaatgtaaatgagttcaaccattatggaagacagtgtgttgattcctcaaggatctagaactagaaataccatttgacccagccatcccattactgggtatatacccaaagggttataaatcattctactataaggacacatgcacttgtatgtttattgcaggactattcacaatagcaaagacttggaaccaacccaaatgcccatcaatgttagactggataaaaaaatgtggcacatatataccatggaatactatgcagtcataaaaaaaatgagttcatgtcctttgcagggacatggatgaagctgtaaactatcattctcagcaaactaacacaggaacaagaaaacaaatactgcatgttctcactcataagtgggagttgaacaaggagaacatatgggcacagggaggggaacatcacacactggggcctgtcgaggggtggggggcaagggaagggatagcattaggagaaatatctaatgtagatgatgggttgatgggtgtggcaaaccaccatggcacatgtatacctatataacacacctgcacattctgcacatgtatcccagaacttaaagtgtactaaaaaaataaataaatgcagaatttcatttctcacacttctggaggctggaagtccaagatcaaggtgtcagcagggttggtttatggtgaagtctcccttcctggcctgcagaccgcaccttcttgctgtatcctctccctgctttttctctgtgagtgcacatatgtgtgcctgaagagaggaaaatagagctcttgtttctcttcctcttttttaagtacagtagtcctaccagattagagcttcaccctctgatctcatttaacttcagtttcttccttaaaggcgctatctccaaatagaatcacattgggggttagggtgtcaacatatggatttgttggtacgtacaattcagtacataataccagtgcacgtggacgtctttgggatggccctgtcttacctaacacagtctgttctctgacccgcaaagattcacatccttctcatatataaagcacattcattcactctaccccaaggtccccagaaatctcaacctattatagtatcaactcaaagtctgtgatctcatcagttcagaactcccaaattttaacactgaaatcatctgaatgagttttgagtaggcctcagggcatactccacccaaagcacaattcatctgtactgtggctctgagaaactggagaggtaaacacagtagtgggacgggtataggatgacagttatagacattcttgttcaaaaagggagaaaaaggagtcactagttccaaacaacttctaaattcagttggggaaactgcattaggtttataggcttgggaatagtatcctagggctctcaggtctgccctctgggagtcatctttcttcttcatgaatggcagcttgagattgtagctgagtagttttataagcatgttttctgcctgagaattttgggggtctgatatggtttggctctgtgttcccacccaaatctcatgtcaaattgtaatcctaacgtgttgaatgagaggctggtgggaggtgattggatcatggggctggtttctaatggttcagcaccatccccctagtgctgtcttgtgatagagttctcacaagatctggttgtttaaaagtgcgtagcacctccctctttgctttctttctctcctgtcaccatgtcacaaagggtgcttgcttccccttttccttctaccatgattgtaagtttcctgaggcctccccagccatgcagaactgtgagtcaattaaacctcgtttcattataaattacccagtctcaggtagttctttacagcagtgtgagaatgggctaatacagcgtccaacagcctttatttgtttcatactccctctctccttttcagtccaagctggcaatgtttctacagatataaattcttaagaatctgcggatcttctatgtatgtcatgggaattcattccattagacaagtggctcttcctaggattcttctagatactttcatctctatgtttgccttctgctgagagaggtttggggtctgtgaatcacacatttaagctcttcaaagggccttttgtgtgactgaatacttaccttttgatctttcaaggtattagcaaaggtttttcagccatgctctcaggatggcagtatctttctcgacagtgaatctcttaatttcagcattttttataatctgaataaagtgacacatttctccaaagaagatataaaaataaccagtcagtgcatgaaaagatgctcaacatcattagcttgtaatattattcatctataaaaaggaatgaagtagtggtacattctgtacgtattacaacatggatgaactttgaaaacacaatactatctgaaataagccagtcacaacaaaatgcatattgtatgattccatctacattaaatgtccagaatagccaaatgtttagagacagaaagaagatttttggttgcgaagagctgaagagagatgtgggagaatagagagtggctgctaattgttatgctaatcttttgggggtaataaaaatgttccaaatttaggtcagtaatggtgcacaactctgaacatactaaaaccattgtgttgtagactttaaatggctaagttttatggtatgtgaattttatctctaataaaggtgtcaagaaaggaataaactaggtagggaaacatatcaacctatccgcatataatcatgtgaagtcacaggtgcctaatgcggtaactcactaaagaaaacaggctgctgaatatattttaaggtttcagtttatttcctggatctaaaagaatggaggtaaggacatgaagagggaatgtatacctttgatgtatttgatttagaagcttaaaataaagcataactacaatttcttagttcataagatgtgctgaataatgctgatgacttagtttctaccatttcaataaaaagtattatgtgactaattttgatgttatgctactagttttcttagactatttgaagacatgtgaatttgtaaggagaagcttttaagataaattagtatctctgtgagactttttatagacataagtctggagtataaccataaataatatactttagtaacacaaagactgcattacaaaaaagtaagcgaaaatacaagcaaaggcacagatttttaaaacaaatgctctcttcattcaaaagaaatgaactgaacatctgtttgctgggccccttagagacatgaagttgcgattcctaactaaaacagaaaaggaaaatatcaagctagtatgggaaatagacttgaaagcaaataactagttcattgatagtagctcctggtagcagaaaagaaagcatgatcaactttgagaaagtaaaacacacacacacacattgtaaagaggtactgactgtacattttcttgtagctcctctagcatcactcaggtaagattatttaatgcaattctcatcccaacaatagttattttgtttcttacatttggggttggatgactctagagagatttcttcagagaaatatgtttttgtgtattttgagtaaatctcacttttgtaaagagagagagtgttcccctgactcacagctgctgccacggcttccttccgtctctagggtttttgtgtatggatgagatgttaccatctcagctctgacctatggattcatatggtgaacaatctgccagtgggacagtttaattcaggaataggtcaaaatccccaaggttcatatggtgatttgcagacgtgctacctggttttaaatttcattgtttctaatctcttgatggtacagcatgatataaatttattctttcattatgataagaatctaccgaggaaataggagtagcacctgcaacacatagcatggattctacctcttttactttaagaaaaaagaaagaaatataattggaagtcttgttcaagcatctgcagtgcctgactcagggcactcaatcaataaatatgctggcagaactaaatgatgtgtttcctgcattctcattgagctttttccttgttactaagcagcatctgtgttaggtccatcgctgacggaacaggctgcagtggtttatttttaagcaaaagtgatctcattggaatttgtgaattaatggtaccgacgttggaaaatggacagcttctttgatttccacctgtttttgtgaagtgttggtaaggaagcaaacaaatagtatccattttgtaggaataacatacaaattgttctaaatacaaagactgctttactctgagcctcagcttgggggtctgtctcccctgtgaagctagccctccataacccttgtctcctttgagttttgaaaacacctagtgcttgacatctgccaaccgattcctcacacatctttggaggagtcatttcacctctcagcagctcagtagctcaatgtaactttccttcctcctcattatggtggggatcaggagagataataaatatcattgcactcggaagactataaagcactttagagttgtcagttattccaaattgctcacaaaagcagaatctcacagaaagtcttggactcttctgggtagattttctttgttaccaagctgagtttgtcagtagcttacctctacctgcagggattgcatgcccctccagcagctatgctcgggtgatgggatttatttctagttttctggtatttaaaatatttagagaaggagttccaaatggttctccaggaattttactatttaacaaatatctgaggaagggaaaggaggctgagaaatttgcattacacattggccaccgtaaagagtaactacatcactgcagatttcagcatgcctttacatgctggtgagctaaccaggccaagtcaatttgaagtgccatggagttttctatagtatatcaagctaaagggctggaaggaactttatttttcagtgatccctgaattgcctttgggatgaaatccaaacagtgaaagccactgccccttcttgcatcgccacctttatgttgccttccagtttaagaaggaagattgagcacagaaatgttccttgttttgatggcaaaagcatgtggaagtgacagcaaaataaataacgaaaaacacagctgcagccgggcatggtagctcacacctgtaatcccagcactttgggaggctgaggtgggcggatcacctgaggtcaggagttcgagaccagcctggccaatatagtgaaaccctgtctctactagaaatacaaaaattagccgggctcggtggcaggtgcctgtgatcccagctactcgggaggctgaggcaggagaatcgtttgaatgttggaggcggaggttgcagtgagccaagattgcgccaccacactcccgcctgggtgacagagcaagactccgtctcaaaaaacaaacaaacaaaagcatagctgcttctttctcaaaaacaagaacaggagttcttcacatacctggattgaaagggaagacatcctcataagaaggaacaggtaaaaacctatggcaggagggaaggccaaatttccatcatcctcaagtcatagagactgaagtcaggcacaacaggagggcttggaaggttggttttcatgagagaccaggggtacatggagtccctgcctgaaaactgggttcatggtcagaaggcctcagatcacatcacccatttgggggaaagggctccagcctaaatgaccaccaagacttagtttagagctgttacctagacagaatctcaaaactgcctgaggaccacccaaccaggggcctctcaagacccagaacacttgtaagacagaagcttacaaccaagaaccacaaagcatcttcagaaaacatccccccataaagcagaaaccaacccaacacacatgaaaaccaaaatccaaagaaatttaaatcaatagggaaaagagaaaatgacattttagatttttgaaataactatcactatgctaaagaagcatgaaactataaaatatgagtagatgatcttgaaaaaagttatttagatatattagatattaaaatgtaattattttaaatttaaatccttagttgggtaatagaacagtctaggtgtattaaaatattgacaagtaggagattgaactgaagaaatcatccaaatactcccaaagtcaaaaaggaaaaacttaagaaaaagcccgaggtgtggggattgacctagaagctccagcacagtccagatgggattctggaaggaggggatcaaatgctgcaggagccatattgtatgagataattactggtagtattcctgatgtgaagaaaaatagtctttaagctgaaaatattactgactgttaagcagaatttttaaagaaaatccacaagtggacattttttctaatggaatttcagaatatcaaatacaatgagagaatctcccttcccctctaggatttcctgttcacattgtctgccacgccaatgccaacacacacaatctcttgaaaatactgcatccaccgacaactttctgcccttatgagccttcctagcttgaatgtttttctctctcctttatcttggctagcagcctctttccttcagcaagtcctcctggaatcaatccctcccactttcttatttaatagtctgcttccatattagcaggacaagccctgttcctctcagccccgtccctgctatgttctgatcattcattctgctttggttccactgctctgtgagcttgtataaggcctttctcttcttcagggctcagcatggtttgtggaatgtggcagtctcctgtgcctgtcattatctcagatgattttgggaatgaatcaaatgataaaccaatgaattagatatcagttgaatgtgcaaatgagccatctaggtacagagaggccagcagtgagtttcttaaggagacagagctaattaaggacagagtcatgtcctggcttgaatggagcaattttgatagcatatatcataatgcctccaccacatactttccctatatagaagtcttaagtgttttaaaaatacctttaaaaaacaaataaaattacagtttttaaaataaaatacatgtatagaaagaaagattttcagaaagtgaatacattgccttttcatcttttatttccaacgtttgtttaaatggcagtcttacatgttttttcttatgaggcacatagataccttaagttgcatggctagaatcattcttgaatagtgaagtttaatcagataaaatgtaaatttcaacatgattattattttctgaccacgtacttaagaatgtctcaggaagttttagacttcttaattgcaagatcagagtgtaactttattagattaatgtctagtaatttttaaaattctcatttattgtcgtgtatatggaagtgtgtcatgtttgaagccatgtgccttttcctgaggctgcttcagccacacctagaaagctcctagagcgaagaaagaacttggtttggtttaatgcactatgttcagcgcccgggatagctccatatacagtcatgtttcacaataaggccaccttgagtcacagcattctgtaattttcaaaagactgctacacacagtaaccctatttgatattcaagagatcagtcaatgcacaaaggaatacatgacttttctgacaatttcagtaatttgtcaacaaccagacccaaaaggaagaaaccaaaagtgacgtaataaaacccatgcaatgcactggggtcctagaagctttgaaaattttatttagagattatttattcctatttgtttatgtaatcctaacagaatttctttctgtttttctaacctgccacagagtttaaaacacaaaattaaaagaggcaaatggttctgtcaaggtcaagaacaacagtccaaaaagcgtaacagccagaaattgaaacaagaaacagacataccaccagacattgaaatacaaaaacacacagctctagagccactgaatgtggaatgcacacagacatatgcacctcagttagcaccaagatcaccccacatagcagcacaacaggaaactgttgaaatgagaaaactgggagtctttgaaaaaaatgtgcaatgatatttagcatcttctatttaagagggcagggaagtaaataagcatcctaggtagataatgtccatcagatgtggtcaagtcaatatacagaggagtttcttattagtatcacagaagtgaaggtggtggaatggactggcctgtaggctcacaggtcaggcatgctgacagccctgtgtcttttcaaagtcaataagtggatttttgtgcctctaatggagagagcctcttctgaggaggagcaaaaactctagaagctttgatctctggaaatacaggataaaagctctcagatttttaaagtctcacccactgacgccattaactaaacatctcatcttgggatgaacattagctgagtgtgttcacaggcttatcccaagtgctttctcctaagccttgtaacagagatgcggcaaggcagaatctggtagtctgtgtacagataattggggtttgatcctgtctgagcaagaactaacccacaacccagagacagccagggacaagtgaagcttatggagaatgaagacctaaggaatattttctgtgtctttgaattctcagcagctaaaatgctgcacttaatgaatgcttcatgattgaccaattacatcatatgactgaggtccattctggatatccgtatcttcctctcgactattcccaccctattgttcataaatcaatcctgaaagaattatttacctctgtgctgagaaatatgatcacttacatgctgcaggtgtgggtgagaaggcgtgatgccgttctactgaatcatgatttccttagcataggttttgatagtttaattaaaaacagaatgcaagactggcttttatccccattcacttatggacgtcatgtgtgttcccatccatactatttataaatgacaatcagaatgtttatggtcctctcattttactaattatgaaacaagcttaactctttgctttttatttttttctagcggaagataatagtctgtctcaaaagaagaaggtcactgtagaagatctcttcagtgaagacttcaaaattcatgaccccgaggctaagtggataagtggtgagtccaggtccttcgtgcacaagacatcgcttccccatgcctcacccccactttcaataggttgggtctagtaatttgcctctcggatttccccctttggccacagaaggggatctacagagcttttgctgtagtcatcatcagattatcattctatgaaaatgtgtatctggtaaaatcaggcttttgtaatggtgttgcctcccgagcatccacacagccttcacttaatgagaaatgggtctgctgaagacgtgtcctttgtgtgccacctcccagagacatcatttctccgggggagctgtggggtgttgcttagcaacaggaacagtgcagggcacggtgagctttccttccttctccacaatcttcattcccctttgttctcttgctctctttccgttaggcagaaggaccaaaagcaactcatggagttcttgtagaatagcttccaaatgaaacttggagtgctgtacacagatgcagattcatttattttccctgttgaactttaatttggattaaatctactttccttgtatgggggattttttttttaaaacaacagaacaaaatacagttgggggcagaaggcatatgttcacaatgcctgtgttggttcataacataatctatttcttctaattgggtctgaaataattcaagtgcatccatggaagatgtacccatccctccacaggccaagttgccagcacctccctgttgcctccattgctgttgcttacatttcatctttgcttcagtggaatacacttgaaggtttatcctcaggccagagaactttatagtgatcaaagtctagttcagatccttgcttttataataaatgaggtccagagaggtcaagtgacttttctgaggtcacagagctgatgagtgcgagctgtggctagcagcccgtcccctgacttccaattcagtgctcttcccaccatcctcttttgctgagtgatcgagtgtcgttgtatgtttttctgtcaaactgcttctaaaatgcttttcatgcttcacaaactctcagaaatcaattaacaatgactcttggctgttagtctcctgcttaggggcaatcacttttctttcgtcctctattgtggcttcagtattcatttctgacccttagattagcttatttaaaagtgaaaaaagtaggtggatctcagagggaatgtattttagaaaactggggagaaattagagcagcagtatatcatgaataccaagggcacacagaaattaaaaaacaaaacaaaacagcacagaggtctttttgtttggtggaggaattgactttgcctttgttttcggctgacctgctgaaatgttcgtgttcgtgttcactgtatgttcgtgtacacccgctgcatcagcaaatgcaagcacttgtgggatgccacaggtagaccttgggaggaaaacatgacaactctccttgaggagctcaaagttgtgttggagacgtatctatgagcagccagtgggaatcctaacacacaagactcagagaggaggatcggaagttctcatccttctcaaaggatgtcccagagacagtgcacaaactcagtcttaaagcgatggctaggagcttgttagagaaagctaagaatagagccctggaagaatgttaggtctagaatgttagtcttgctaaaccctggttgggggaaccaaaaccaagctgagaaacaatgcccagcagttacaaaaacaaaacaaaacacttagacttgtggtatttaagaaaatgagtgagcacagtggctcacacctgtattccagcactttgggaagccgaggcaggcagatcgcttgaatccaggaatttgaggccagcctgggaaacatgttgaaacgtcacctttataaaaaactagccagccatgtgggacctctggtcccagctacgtgggaggctgaggtgagaggatggcttcagcctgggaggtccaggctgcggttaactgtaatcatgccattgcactccaacctgggtgacagagcgagaccctgtcaaaaaaaaaagagtgaactctttggtatttgtcaaaaaccaattataaaggctcagttaatcattgcagagttacttcattcactttaagctattacgtctttagggagcaggtttgtccatggaactgtttctcagtggtatacatgggagtcacaccacccaccaccatgatctcccaccaccaccaccagcagcaccagcaccacaggcttctctttctgctccttctctgcttctccttctccttctcgtggagaggcagaattcaaggatgaatcaagaggccagaaacaagggacaccaaacctgagctctagggttcagagtaggttggaggagggcctgggaagacgccatgatatgttgaaataaagtgtattcatacctataaggtatatatttttattagaaagcccatggcatcagacttggcctaaagcagcattccatgccaaaaaaaaaaagtatatgtagagatgtggagacacaagagcacagatgtttctggaggaacgtgtgccagttcatggtataaggagtttgatttttatgagcaaatgaatggagtctgcccagagaggcactggctttctggccagaggagaccagccggattttctttatatccgcaaagctgggagttaatacacgcaattgagacgtggctatgtgcccagcagaaaatgcccagcctgcctgtatcatcaggttatgcctattcataatgaccacctgcagttctaaatggacctgcctttggtgttgaggagctttcttaggatgattctccctctgtaaatgtacacactgaagaaactttgctgtgaagtaaccaagtggttgggtccccaaatacaggtttgatttggagtgttttggaacctaataattccactcacacatgaccctcagcttccccttacctttttttttttatcttattcctcttcctaaacattctctctcttcccgctccctaaagaggcaatagcttaaagtgaatgaagtaactttgcaatgatgaacggagtctttataattggtttttgacaaatactatagagttcacccatttttttttaataccacaagtctaagtgttaagatctgggaaaagattactacaaatccataggattatctcatgttgtagagctgggatgagccttagaaattattagaacattaattcattcagtaagagatttttgagtgcccacagtgtagcagacaaattgctgggcccaaaagcggtgagcgatttgttcatggaactgtttcttagtgatagacataagaattattacccaccaccaccatctatcaccactaccaccatcacagtctcctcttcctcctcctcttcctcacatcaccgtcatcatcataacatcatcatcaagatcatattatcatcttcattatcttctgggtgtttactgtgtcttaagctctaggctaaatgatctatatacatatatatatatatagacatttaattaccacaactacaatgattcccattttacagatgaagaaactgagtctcagggtattgaaataacttgatcaatatcacaaagtttgtaagtagcaaaattctgatttgaacctaggtctgtctggtttttataaactaccctattctggataaaattcaggtctcctgccaatttcttttgcaaccttagtagttacattgtgtattttaaccaaaattataggttccgaacagttcagaataattgccactttttgaagtctctattctagctttctattcccatagtgaccatgtcaaagttacaaaatacgcaagagatgaagaaaaatggtgtaattctctacagaggaagagacttgattttgttttttgtttgtttgtttgtttgttttttagtacacattaactgctgaagttaacaagtgtaccttgggtttaatattggagttaacagtctggaactaatacgctttatttatcaggaggaaatgtgttaggttggaattgaatttcccttccctcatttttatactgtatgcttaattttttaaatctaccttgtctgaaaatgattggtacaacagcctcacattctctaacatcctgaagaccttgtagacttccttacttgtttgttgcaactactggggcaagccaaatgaggtgtgtaaagccatgaaaaggcccactctgggccaggtgtggtggctcacgcctgtaatcccagcactttgggaggccaaggtgggtggatcatttgaggtaaggagttcgagaccagcctggccaacatggtgaaaccctgtctctactaaaaatacaaaaattagccaggcgtggtagggcacacctgtagtcccagctactcgggaggctaaggcagcagaatcactcaaacctgggaggtgcaggtggcagtgagccgacattgcgccacagcactccagcctgggtgacagagcaagactccatctcaaaaaaaaaaaaaaaaagaaaagaaaagaaaaagaaaaggctcactctgggctccctctcaaagaggtgcacactcccagaagtggtcacagcattgcctctccaagtatttgctccattgagtaaattcttatacctgttataacaaccgcattgcacttcttaaccttttggagcccctttgtgccattctgggactccactctaggggctgtgatgagatattttggttactctttgtttacatggaccaatcatcctgggctcccctggcccattccctctttctcatttctagatgatgataattgcaaatctcaccttctctgcccaaccctgcaaactccctccccatcctccttctcagctgaaactgccagaagagagcttaggaacactcccactgtcctgtcaactggcctcaacactgccgctggctcttcctgcaccactcccaccccgcccctgccccgccccacaggtgacctgtctgctgtctgcactcaatctaaaggaaccacagatgcactcgcttcacttacctgaggaatcattacagcaggcccctcctttctcccctaaatttttgttctgtattggctgattcctatcatgaacgaaatgtggtcttccttctcttaccttaacacaaacacctcatctcaagtccacatgccctgcctggctcggcctggcttccctgttcccctttgcagcctgaagcagtcttctatctgtaacatctccaggtactcttcttccactctccctaaatccactcccgttaggctaccacgcccagcactctccgaaactcctcttgtcaaggtcagagatgacctccaggttgctaaatgcaacaggcatttctcagaccccaacttattttacctgccagcagcattggacaccattgattcctcctctgccctggatacacttttttctttcttgtcagctcatgggcatctcctttgcaggagggttggccggttctccctcttctccctgacgtttaatattgctgcaagactcaggacttgttcctctccttttcatggctgcacgccctcccttggtgtctccctccagtcttatagttttaaatatcctccatttactgatgattcctaaacatatgtcatcagacaaaccttctctcaaatctctcagatgtctgagagacatttcaattttaaccttaatatctccaagtctcagtccttgatttccccccaaaaccaaaaatacaaaagaaaaaaaatccaccctatccacaacctttctgatgtcagttgatggaaaaatttgtagaacaagctaaggaccttcaagtcatcttttattctactttttctctaacatcccacatccgatccatcaagaaatcctgccagctctgccttcagaacacacgtgcccatcctagcctccacgtgatgtttgggtgcatgaataccatggcagacttggcatcagtccactcggagggttggagggctggactcaagcccagcagcagcaggaaggaccgaggctctactccggcacctcaggtactagctcaggtgcaaggagaaggggatgcttgggtgactggggtggaattttaatgtttctaactttaaaagtctgaattcctcaagtttctcacttatcctcactttgtactccctgaggggaaataattcacccccacaatgttaggtattgtctatatgatgatgagtttcaattctctagctcaaatgctcttccgagctatacacttggagagagagagagaggggtgtgtgtgtgtgtgtgtgtgtgtgtgtctgtgtgtgtgtgcatgtcagtcactggctaatttccatgtccactgcagtatcttacattcacctcacatcctcatgcccagcactacatcatcctcccccaacctcttcacagaccccccgctgcccactgtgcgagcacagccctggccccccgaccctccatgtctcagactctacatgatctgtttactctcctgactcatcattggccatctccccagttttctcttaaactttgcctacgtgaacttctttggattgcttcagaagtccatcttcttttcccccagagtggctcttacataggatgttccttctgtccagcccactcgctctcctctccgcgtccacttgtgatcactcctagtcaccaccctgcatgttatctttttcctttaagttgctccctaattcttgctctgccccacattgactcttctggttttggattctcctatatcctgcactgacccttttgttacataggttaagtataattatttatgaatgtaaactccacaaggatgggactcgcatctctgtttactgtggtatccccagcaccagcaaagtccccagtttgtggccgtccacgaagacttcttgggcattttctcatttgatacttaaacagcctagttttaaagataaggaaacttacaagcatgtgatttcacatagaatggtggaaatcttttctgatcatgtgatttgggggcagggacctgaaggtgaggatcatgcagatgagttctctgggggaaagccttccaggcagggtggaacaaccaacgcaaaggtcttggtgcaggaggctgcttggcatattcatgaacagtgttgagcctgagggagaagagccagagataagatcagagtggaggctgggaccaacacctacaggctctgtggcaatgaagggggcaaagggagtatgggggagaatttagagaagctgagaagttgggtttaacttattggcactgaaggttttagaataacaatgacatggtgcaagcttaggctgatatatcaacttcttgtattatatatactacacatttgttatatgtatgtatttattacagtaaattagaaatcagagattaacacaaatttaaaagatactaaaaattacctgtaacccctctaactgaaaatggccactattaaattttcatagctctccttccagataataacatatattgaataatactaagtgtattaagtaggaaaatattcataacctatacatacatatattctcatggcagtaagtatacatcgtcattatctttttaacatcttaatagtatttcacgatattaatgtgccttaatttgcgccatcttctgatattgaaagtttaggctgtgacaggaaaggaagtggcaggtgtaaaaagccatggtgagtgacaaatcagcaggaggtggtagtgtatagaaatggaacaccagggaagagagcactgtcaaggctgacttgaggatctcaggcctgggcagctggaatggtgattctctattcttgacagggagtcagtttctgtgactggatgaagagtttggagtggaagtctatgagcaataactcggtggaaatgttcgttaggtattgagaactggggatgaagccaggtgagaggttggagccatctggaggaccatggaaagcgtgggttgtggaggtactgctcagagcctctcggagggaagaggggaagagggacacggaggtgtctgaggaagtgtggtcagggaggcaggaggagaacttctaccacgccacgtcaaagtcaaggcaggagaaaatgctctaggcgagttagtgtgctgccgattttgtaacggcagatgtaaatgaaaaaccaccccacggtggccacgcacctcttcctggctcacagccccagggacgtgtttgtgtagacaatagtggtgatcatttgagtcatatttaaattgtttatttctttctgttaaaggtaaactgaggcacaatacaatttttttttttttaaaagcatttatttgagcaaacagtgattcatgaattgggcagctccaaaccagaagtggttctggggttctaccaagggaacaagggagaaggcttttacagaacaaagacagaagcaaagcaactatctgattggttacagttatggagttgccttatttggtcaatcctgttggaaagttcttagttacagaagttagttgggagcttctgactggttagtctttaagtttcacttttctttaatataggcatttatgagaaaaagcccaggtgaagtttttgtttcgttttgttttgctttgcttttgagacggagtctcgctctgtcgcccaggctggagtgcagtggcacaatcttggctcactgcaacctccacctcccgggttcaagcgattctcctgcctcagcctccctagtagctgggattacaggtgcacaccatcacgcctagctaatttttgtatttttagcagagacagggtttccccatattgctcaggctggtcttgaactcctgacctcgtgatctgcccgcctcagcctcccaaagtgttgggattacagatgtgagccaccacgcccggcccaggttaaattttatttatgtttgcaattcacacaaggtcaaggttacttacacttacaaggccaactggctttgtctccttgaggattctttaggccttttaacttacttttaacatcactaaccacactaatttatatggcaaataccctcttattgacactgttgcagactatagtaggggaaaggttaattccagaagcagggtgaaagacgcttacatgcagacagctttccaccctctcctcaccgcatctgtgaccaacagaaagtgtctcctctgtcttaacagaatttgtcactctgctcaggtagctgatgccactgcacctggtgagccacctagctcaacaaacatatttgcttttacagatctgccttttatgaaggcagcctgggctaaaccttggaaatggtttgataagccccatgccctgtgctctgagcaaatcgaagcctcctgcatccttcaaggggtcccctctcctcccgtctcctcccagtatctcttggatgcaggcaggcctggagctgattgacagaagctgctcgctgggcctgattaacttgtctgctagctccaggcagagcttggcctcacagcccatccggctcctgcctcctccccgccccctgcagcatgttcaactttagtctgaatatggtgatagaccatgtggctggcaccagcatctctccactgtctgtgtttgtttacgctcattttcattaatccagccacttgttagcagagagccctctgtgtctctaggatgcggtactagagagactgtaaaattgaagaaaattgcttcctttgaatggaggaaaatatcagctggctggttgatactggaaaagtatatgtttcagaagataaaattggagttagtgcacagggctcaaagcaacttgatttccatatgtgctttatcctcttctcttttgttatgctgaaaaaacagatgggttttttttttaaataaagcttatggggttaggtagaggggggaattcaagtttaaaatggtttgggtatttccactgctttttggaggccacatttttcaatcaaaaccattaagccttagaattgcagagagtaataaagtcccctcgagggcacttggtacagcagcctgtatcccatggccagcagggacttcagggaagtacccaggaagggcaggcttcgtaagagggactgtgttctcccacggctctgagagtgtttggagagcataacagtgatcatttgaagtcattacataaaaatacacactgaagcacatcgttgtaccttaatgaagtccttaagaaataaacaaaatgtaattatggtttacattggtgtaaaccaccagtttattttttctctcttttgttgtcatgctcaaggtcgcacctttccttaagagaagagagcctcagttgtctggcattaggaacccaatcatgtctctgactattttcgtgcagtaaaatctgtccatgccatcactcccattttttctgcctaacacagtttcaacagtatcctgtctgcacggccaggcttatccttaaatgcatcttccccatttctggtctctgagctaagacaattatttgcttaaacttctgcaaaagtttcctattggagttttctataggacctacgggaagaactcaaaagacagtatcatttagcgccagcagcagcggaagcaataattgcaacaggaattgaaaggataacagtagctgcatgaaatatctcagttacttcagttcagtcttcactgaaacccatggaggcaggaattttttttttattatactttaacttttagggtacatgtgcacaacgtgcaggtttgttacatatgtatacatgtgccatgttggtgtgctgcacccattaactcttcatttaacattaggtatatctcctaatgctatccctcccccctccccccaccccacaacagtgctggagaggatgtggaatttttacctttactttagaaataagaaaactatgagtcaaagacactaaatcactttttcaaagttaccaagatggctttagagaatccagggtgttcctgcctcagtgtaccttgcctccccggtctcctcaccacccctactcatggcctctattttgttttttttttgagatggagtctcactctatcgcccaggctggagtgcagtggcacgatctcagctcactgcaacctccgcctccctgattcaagcgattcttccgcttcagcctcctgagtagctgggactacaggtgtgtgccaccacgcccagctaatttttgtatttttagaagagacagggttgcaccatgttggtcaggctggtctcgaactactgacctcgtgatctgcctacctcgaccacctaaagtgctgggattacgggtgtgagccaccatgcccggccactcatggcctctattaccacgttcctggccatattaggttctttggcagctttgtgactttattgctcttctctttttctgaaaataccgttgctcatcacttctctgcttcagaaagtctcattaatcctcatggcttgacccaaaatacattctctctgattttccaaattagaattagttgtgtactccacgataccgcagtagaactttacaaaacttcagtcagagcatcagcttgtgaaccagctagggttggaccaccttggggatgcagcccacttcgcagaggctggatgcacttcctccgtctgaaagcagagagaggtgtgtcttggggcagggcagccgatttcttccacaccacgctggtcccttccagaggtgctgtaggtcctctgcctgtaggtcctctgggcggactctagttcctaactgatggatgatgctgggccccgctgttgatgctgcttaattcataatttggggactcaagtctctgcaggctccactgggccaacttgcttcctgcagagatacatgttcagactctactaattacttttccttggcaaacgttgcatccctgggaaatttaaatacaacttccatctttgttgactccagtttagaccccggccaagactgaaatcgcgtttcaactttatttgtttgcagtatacagagggacaggctcttctttttttgtttttgcttttttgatttagggaaataaatatttgattttgtgtgtatatacgtgtatacgtacatatttttttctcttaagtaaagggatctcatgtgagatgttcatgtttttttcctactctgataagtagacagatattctccaggtcattatacggttgtttccagggctccaaggatctcaagaaataatcctgaagaccccgccgtactcagcccctccatcctcctacctaatagagcagatgacaggatacgccgtgcagcgtgccttgtggccagcctggtctttcttcaaggtcaagctcaaaatcaaagcctggggcaggcggttttctgcctggcaacgcagctcagccccagcagcccacagaccaggatgcaggagtttgttttactttagttccgttccaattaaaagagtctgagagctcaggtgaatcccaatgcactgtagctgtttggcccaagggtgagattctgccgcgtcctctttttagagtgaagcgcattcagaagacccattaattagagactattcatccttcaacacgatgatattcacatgagcactgacaccaccatttattgtctcagttaaattacttcacagagtccttaaccatggtaacctgctagggtctaattaattatcattgacatcttttcaaacatcgatcaccttcttaattaataaaaaagactcacttgatctcttcggtaactgagcaccgtcccctgtgactcatcaatcttttgcccacagcatgtctcacttcacattcaggtgtctgtctgcatctctgtctggctcttgacagcaaacatcttgggggtcacaggtatgttgtagtaattatcatagttccctcataggtcacagtatctggggtgggataaagtctcaataaatattaactgattgaatgattcagcaaatgggcaaattgagtctccagagaagaggcctctgggaactgaatttttggttaattgagggctggccaggctctttattgtaactcttcgtgttttaagaaagtagacacacgtgggcggggcgggacgcagtagctcacgcaagcctgtaatcccagcactttgggaggccgaggctggcggatcatgaggtcaggagatcgagaccatcctggctgacacagtgaaaccccgtctctactaaaaatacaaaaaaagttagccgggcgtggtggcgggtgcctgtagtcccagctactcgggaggcagtgagccaagattgcgtcactgcactccagcctgggtgattgatagagcgagactctgtctcaaaaaaaaaaagaaagcagacacacccttgtaataagaaacgcacatctgattctattttcttgctttaactgggactctctaacagatgaaagagatagctcctgctactcctcatactagatgtgttctccatcgtaagtttgatacttgccacttattgatcatgtgcagaatgtgccagacatgatgctaagttcttaatcacttagcatcccgtgaaagacaggcgaggccatcgtctctacacagcccacatatttacaaatcttccaactggatggggccatccagaaacacaggcatgaagctatgtcctatggaaggtactgtggccttttaaatatttggggtgtgatatcatcctggtctcttttccacctaaatccccgtccctcctccatcctccatcctgtgcatcactgggacctcatgacgtgtttatctctcagcgatactttgctaccagcactgcatcttctctgttttccaaaatacactaacacaaacatgcttcataacagacatttacaaaaagtgacaggatgacaaaggagaactgtgggtaccacagaagatgaagcaacaccgatatgaacagcacggcttgctcttcttaaagcccctagacattcttgcttaagagaacctttccttgactgcccctttttctcttgtttatggggtcttccaacaactgcatggcctggttgtgctgcggttgcttctatcacagaacttttccgtagcccccattgccctaaactgttgccaataaagaccaagttgggattcagggatatcgaagtgaatcagagttctcttcaaacttagtgtgaatctcatgttcacatttaaaatgctttaggggcccttttgtgcagggctgacacccatatcctatgctcccttcgcaagctgagtatttgcaggacgctgttctgagattggtgtagacctttctaatatccggcactttgcagttgaaatggaattcgtgctttgtggtgtcttttctcatatctctttagtgtaaaagtggtagaaatgtgtagaaatagatatagcatctggatattgtgatgctgagcaggttctgggcttttaaacccagatttccaaaataagtgccaacctcacatctgatgcttctgccgagtgctccctggaacccagcctagaccgtctcttgggtcaggatcttctgttctctctcaagaccccttattcattccccctcttctctgaatattttgggatcctctgaaatgtcctccctccagaaaaaaaaacaggtgatagctctcagattccagcaatttatgaagcagattaatctagctgtgctggtcaggcctctctcctgtgctcctgcctcaggtacctttctcaaggatcaacaaaaagccaaatgcaggaatttccccaaacgaaagatacgtttctggaatttctaccctttgcgaggcaaggaaccgacatgtgcattcattttcttaacttctcccagatcacattcttacacaggacaacccaaagaagggaaagatggaataaacctcggaagttcaaagtagcagaatgtttcttatttacaccagtgttacagatcaggggccctagaatcagagaagttaagtcacttaccttaggccacacagctaataggtgacagagctagtctttactttgaaaatgcttctgacaattctgaaaacatgcccaaagtccagtggaaagttatgttcactaaatacaacggtaccaattaagtcttcatagggttgaacttgaatctgcaatggaaatctggaagtatctgtgaaggatgagacaacacccccaggtgtctcttcccccggctccctcgtgctctctcaagatcagcccagctcattagtgcagcccgtggctacatccaaagcacgcagccctccttgctgcagtcttttgcaagccaggcatcctgaaggtcacagcagaagtgctgtggggtaaaggatgagtttgtcagcagtgccccgtggctgcctggggctctgaagggcagccagatggagtgtgagctttgccttttccaccagatgttatttacttatttttgctgttagcttctcactcccatctcaaacacctctgggcaccaaatacttgaaagtagtttgtgatccgcaaagacaaattcctaataaaagtctgaaaataaaataatgttgctggagaattatttgggatacttaaaagtgttgtgtgttgtatctaacgtgttgctggtgttttccatacatccatgctagctgcttgggaattgccgagttctgagtcaggaattttaatgggcacatttattcagaccctgagcctctgctgcttagttctcaccagtgataacatagtttacagagtgacagccggagaccaggaatgaagctttataagtcattttaattatttgatattacttgtaagttgccgaaggaaggagactcctgtatgactatactgtaggtgtctatttgcgacacaccagtgaacacgcacgtgcgatatacaaaggacaaaatgcatgtgtgatggtcagcgactgagaatgcccctttctggctgacatcagaggggtgcatggcaacaaaatgtcatcccaatctctcatgggatgttttcttttccaactttcttctcaatggcttctgacattaaaataggtttttactgaatataaagtacttatgttcctcaataaaacccaaattgttgggttttaaaaacttaatgttggattaagatctcctaataagcaaggttaaacaaacaagggggttggaaataaaattagggagtgccaatttaccagctgctgtgcgttagcaacaatggccctgttagcgctcccccaggttcttcattaagctcggaaaatccttactccctgattgctcagatcccacagatgagcctagaagaaagtattaaatgtctaagaaaagacacaacatattcaagtctaaaaagatgtttctatttcactttgaggctcaagtaaacccatcccccgccccttgttctcttcccatcatcttcctttgccattggagcctacaattcgtccagaatcctttcctcctccctcttttgaatcagtccttgagacagcataaaagaagaacaaaagctccaccttatcccatcgccatccacctgtcttacatacttgaagaacaggagaagataaataagatggcccagcatggtcattttctaatttttatggagggacttgaatttgaaaccgacaccactgactgtgatcatgcccccagcatacgaaggaggattttcctttgggctcccaggcagatttaggcaagttcctcttctctgcctgccgtgacctttagaaatcatccactaatgtgtcttttcatgacttcccttccagcgttaagttccaggaacttaatctctttaagtgatttctgtccaagctcagtagctcaaggatcccataatgttaccaaaaaagactaagatctccatggttctagctgcatccaacaatgtaaacaggtaaagtagcatccttggagcatcttttattcactttataaatatgataaaagtgctgctaggtgcctaaagctctgatttgttagatgacttgggatcacaaaggcaaataagacaagctttgtaccttgtatttagagcagaaggtatattttaaatgttaaaagccatcgctttatttttatttgattatgctgggggctgaatctgtaacaccttgtatagcacccaggaagtattagttaagtgaatgcatgcagacgcacaccacatggttccagaaaggattctgggcaactcagtgcaaacatcagatagcaatatcccaaatcccaacaactgcaacagaaagaaaataggagaaaagatgagatttgtgcccgcagtgcatgttgatttaataggaatttcaaaagaaaaaaggacgtctgtggccaggtatatatccaaagcctgctttctccttctcgcctcacctctgctggcttctggagctcacactcgttcacctcgtccttccctcgttccacccattccctattctggtgggataccgcaccgggtgttatgagtacatcagctcatttgatattcacaaccattcctgctggctggtggtatctccattttacatatgaggaaactgaaggttagaaaggctaatgaggatcacaagtctcatggctagtgtcataagagagcagatatgacttcaggcttgtctgtctccaaaagccttcgatgtggaccctacaccatcctacaaggaggtggttctctaatccgggatgaagctcttgttcttcctgtttttccttttcctcaacatatgaggatttgttctgaagatcagcagtaaaatctcactgaagggttgaggcttgttttaaacgagtccagaactaagatgtaacccaaatagaaaaacagtcagtaaaaatccacgaagctcccgcatccctcttcttaaacatggcccagtgacccccgtgtgcgggttaaactcgagattcctttagaagatcgtgcttcttatataactaggactaatgaaagcagcctggaaatgagtgcacagtttgatatgggacccatcaaagatgtcattcagcctgaggataatgacccccaaggctgctgcaagagccatgtttgagctagagccagatctccttgaagtttatgcttcaataacttcgttaagcctccttggtgcttttgggtcaagcatgactttagtaaatgaattatacgttggataagggtcattttgtaagtgaaccaaatgatgataggaaagtcattctctgcccatacttatggtgtcatctgtaagcacagacctgcaactttccgtggttcagtgagactgagaccctgggtaggtgcactcatcacaggcctcacagggagattttatttaaattgacacaaagaattgaggattggtggcccatcgttttatttgaagatgtagacagcaaaactaaaatatttggatttcttttgttctgtaaaagatttatttttatgttttgaatgcctaaagagagaaaatagttattgtatgatgatggtcatcttacataaatgaaaataccatttaatgacatgaatcttattcattctaagaaattaaaatgcctgtaatcattcatttatattgttgccttgttatttggctttcgtgaactgtgtaaaaagttgtgaatttttaaagaattcaagagcaggattccgtttctggaattcaatatcggtcacactgtgattgcgaaacctctgtatacggatgcaggcagggagttttgttttgatttggtttggtttatgtgtgagcaaaatgtgtcatagatctgtagaaactatccaattttatagatcctttcaaacatggagttgccagacttctcctaggaattgtagcaggtaagataagccaagaagtaagaggaccatctgatagttcttatcttacttagatggaaagtggaaagctcatggaaactagaaatttttgtgtgtgttggttcttatttattaaaagatatattgccggatattgtggcttacacctgtaatcccagccctttgggaggccaaagccgaaacatcgcttaaactcaggagtttgagaccagtctgggcaataaagtgagaaatcatttctacaaaaaatttgtaaaaattagccaagcctggtggtggacacctgtagtcccagctactcaggaggctgaggcaggaggatcacttgagcctgcgagggacaggctgtggtgggctgacatcgcaccactgcactccaccctaggcaacagagaaggaccctgtctcaaaaaaatatatattatacatattttttattatatataaatatataatatatgataacatatatttatatatatatgtatatcacttgtaagcctcagtagtttaatattactaacaaacttcacagtgacacatcacacaaatgatctcagcatcctagaacttaaaatctaggatgaatatgttcttataatttttgtttctttctatatttcagataaaactcagatacctaaatttcatgatagctttctccctgggaaattatattctcttcttattgcaagcaccacattattgatttccctgatacctcattaccaagactcttttctgcaagagaaaagacgctgagtactttatccaagtttcacatcaggcccagtgatccccaacccactgtctttccatcaatttgcctcctccaagtcaaccaaatgcattcagttaataattgaaaaaatggtataaaaataaatcaggcatgtatagacgttgtcctcaggtacttgcagattaagggagggagtcaggtaaatggttaaagacataacaaagcatgggtgctttctcgagatacagacagaggagggagaatacagagaaatggcagcttcctgctgtaggagcttagagagagtctcgtggaggtgacatttgaaccaaagtaacatttgcacataactaggacattgccatgtagaggcgtctggtatgaggagggagcagggaatttctctaaatattgcaggtaaaaaggtttaggaaaagagttgtggcatatccagaaactgatcagaatatggatttggcttaagcctgcaacattcagtatctggtaggaaatggggccatgagtgtgaggagaagacagaccctcagggcgtttctgcaggcccctctctagcagctggggccatggtgggctctgagtgatgagagctttttatttcttaaatgatgagggtggagtgtagatagtgggctaggagaaagacatgtatatgtgtttggctttggggggtttgttgtggtttttttttttttgttgttgttgttgtttgagacagagtcttgctcagttgcccaggctaaagtgcagtggctcactgcaacctccacttcccaggttcaaacaattctcatgcctcagcctcctgagtagctgggactacaggcatgcgccaccatgcccggctaatttttgtatttttagtagacactggatttccccatgttggccaggctggtctccaactcctgacctcaagtgatccatccaccttgatctcccaaagtgctgggattacaggtgtgagccactgcggccggcctgtatatatgttttaatgagtcactttctacataaaaagttatttgcaggaaccagtgcggggaggtaagaatgacttaggcaaatctccttcttttaataagcttggagtccaacaacaagtgggcgagtcacaaacaccaacagctgtgtgtgtacccagatgcaggaagggacacagaaggaaaaagacacactgaacatttggcacagcagtgcattgagccagggactgtcagagctgagtgctgtgggcctctggtaatgaccattaaacaaacacctgccagaaagaacttctcctccactgggattcaacaatagggaatacctcatccagtctacctattcgtaatagacaatttagtaggcaaaatcttaaattttcataaagaagaatatcttaagagttggaggtttcacacatattgtatatcttaattttcaaggagatgcctatgatatgtttctaagatctttttttttcctctctggaataaatactagtgaacttaatttatttcaagaagaatacagatgcacctcttaaacatactacatacactccatagtctcagaatccaagactgcaaatctcctgtctaaaaggaatgagttaatttttgaaaagcagagtgaagatgttatgacataaaagctataaaaattcacttaatttaattaacttgacccgaaggggagctatgtgagtccagagacttaagattttttttactatgtgagaatatcccattaccaagtgtcatatatttatcccataattttcagcatgttttactgtggggttactcctcaatggcaaatgttccctgagcacaatgaatggcatgcgcccgtggctagaccccacaagaaagtcaagctcctttgaacccacagtgtgctgggggtcttcgactctctggaagaggttttgtgaaggggcctcttcaacagaaaggggaaggagtccttttggatctgccccatcgttaccatccagcctgctgtggaacaaaggagaacagacctaacgcctgtgcttggaagaacttggaaatgtgtgctgggaaacaggatcgaggccttccttagtgtcacttcataacatagaagtgttcacgtgacacctgcttgtttagatgactggtgtagctcaatcttccatgattacagctacagaattttggatatgcttttattgtttagcctagaatacatttagagaatataaaaaatttactcccatctttaaggaggttacattctggctcatccattcactcatgcagcattgtgttgaggacctactatgtgacagggactatttcagccactgggataaaaaggtaaagaaagcaaactccctccctccccccatgaaccattgtaggttaaaatagcccagtggtatttttcagagctcaataccaggcagaactggatgtaaccttcacaaacttggaattccatctcacatctgacagactaaaaaactaaaatcactcaagtaacctgcccaattagagtctcttctagtttgtactataccttcaacctggagttgagactgaggaaggcggaggaaggtgagaagaagggagtgttggtcaatcctcagaaaaagaactaggacaggctgggcatggtggctcatgcctgtaatctcagcactttgggaggcccagttggttggatcacttgaggtcaggagtttgaaaccagcctggccaacatggtgaaacccccatctctactaaaaatacaaaaattagcaggatgtggtggcgggcatctgtaatcccagctacttgggaggttgaggcaggacaatcatttgaactcgggaggtagaggttgcagtaagccaggattaaaccactgcactccagcctgggagacagagtgagactccatctccaaaaaaagaaaaaaaaaaagaaaagaaaaaagagctaggataaattagatcatcattcacagcagcatattcacaatagtatcaaataaaaaattttgaaaatagaataaatgtatgcccattttttaaaattggcatgcatttcctgaatatgcttagaggaaaaagcctgggaaggaataaaacaaagggtcgtcaatatttatcttctaggatcaggcatgctttttttctttcatctcacttatctccttacagcatccctgacaactggacttacctgttttatctttataccagaaaccagcccactctaccaggccatgcaaggtctttcctgctcagcaggatgatgggggaggacgcgttgtgtctctatcatggcaatcagaagaaggagaagatattctgtcatcagggaaggggtgaaaccgagcatgggagagaataatatcagaggcagttgcctgcttcatagatagttacagaaaaacatctgaactgacatggtgcttacatgagattgccacagttgatacagctcagaatacagccttttgaaaagtctaagcttagaagcagtcgagaacacaaaaggaaagaaaggagagtgaggtacttggactgagcgaggtggaaggtaatagaatcccaaataattgggttaaccaaatacgcaatgaattttcctcacatacaagcaatcagagatagaccatctttttattattttttattttattttttgagatggagtctcgctctctcacctaggctggagcgcagtggcatgatctcgggttactgcaacctccacctcccaggttcaagcgattctctgcctcagcttcctgagtagctgggactacaggcacatgccaccacacctgattaatttttgtatttttagtagagatggggtttcaccatgttggccaggctggtctcgaactcctgacctcaagtcatccaccctcctcagcctcccaaagtgctgagattacaggcgtgagccaccaagcccagccagatagaccatctattatggctagtgtcattgccctcaaatatcaaggacccaggcttctagagtagggtgttccaacctcagcactattgacattcggaccagatgattctttgttgcagcagctgccctgtgcactgtaggatacatgcctgccctctacccactcaatgccagcagcacccaccacctacgctgtaaaaatcagaaagtctccagacattcccaaatgtcccctgagagggcaaaatcagcccttgttgagaaattactattctatatccctgctctgccatcagtaacatatggcttttatctttagattcacaaaagaaaagtaggcaggtgagtttgttggcagtcacagctctacagaagccttgtggtagctttcagctcacatctgtctcgtggccctgagcttggccacgtgactaaccctttgttacttgcacagaagtcggggaggagaatatttttatctggacatattgaatccctagccaacattagggttctgaggaggacagaatgggtttggggcaggtgactggcaggctctacaagaagacattagagaagaaaggagtaaaacagatatttcactgacctcaatgataaggcatttcatggatacaaaaggagggcccccctgcggtacaaagcatggccattctagcactgcccccctgccttctaggagcacagagtgtctgtgagcactgcagcagcccattcccaaagaaactgggctcctgttcatattccacgaggcaagtcttagaccataggtgtgcctgcagtcactccaaattgcatgtccctgcagtgtgaggccaacattaagtcttgagatggagcagcgttaattggccattgcttaagagtctcttcattttctcatctcatgggttttaaatattttttaatgttttataggtcctttaggacaccacaccttttcatttattttagtatattttggttaaaaaaattctgtgatgtttaaaattagggaataataaaaaaattccctatgaaacctcacccttagcttgaagaagtaacaagtcatagtgaatctctgtttcctctatatccccaccacccaccaacccccccagatcccatacactatatcattccatctacagatatttcagtatgtgtgtgggggtcctaaagacaaccaggtttcatgagtcactgggaggactcataagagtcagcatttagacacaattacagctgtgagttattatcgtgaaaggatacagaacaaaattatcaaaaggaaaaggcacatggggtgacatccagaggaaaccaggcacaaacatctaagggccctctctaaacacaatacatgcttagtgcccctggcgagttgtatagcatgggcatgggcggactgtcatctaccagagaacctcactagagactcagttcccgtgggttttataggtggctcgtcacactacattctagactttcagaaggaaagcaggtgaccagccaaagccacagggaacaaaatagtttaggcacagaaagccactttgatcagtgatcagtttgaagaaaaatgtccaggaattattatagatagtggtgatggttgcacagctgtgtgaccattctaaaaaacattgaattgcacactgtaaaatagttaaaatgatgacttttgttatgggaattttgtctaagagaaatacatcccagttggcaccatttctataaaaaggaatagtgagagataaagcttataatatggtttcgctgtgtcactacccaaatctcattttgaatggtaattcccacaatttccatgtgttgtggcaggaacctggtgggaggtgactgaattatgggggcggatctttcctgcgttgttctcctgatagcgaatgagtctcatgagatctgatggttttaaaaaggggagtttccttgcaccagttctgttctcttgaccgctgccatatgagacatgccttttaccttccaccaggattgtgaggcctccccagccacgtggaactgtaagtccaataaacctctttcttttgtcaactgcgcagtcttgggtatgtctttatcagcagcctgaaaatggactaatacagtaaattggtaccagtagagtggggcactgctgaaaagatccctgaaaatgtggaaatgactttggaactgggtaacaggcagaggttggaacagtttggagagctcagaagaaggaaaatgtgggaaagtttggaacttcctagagacttgttgaatgttgaatggcttttcccaaaatgctgatagtgctatggacaatgaaatccaggctgaggtggtctcagacagagatgagaaactagttgggaactgcagcaaagatgacttttgttatgttttagcaatgagactggtggcattttgcccctgccctagagatttgtggaactttgaacttgagagagatgatttaggttatctgcttgaagagatttctaagtagcaaggcattcaagaggtgacctgggtgctattaaaggcattcagttttataagggaagcagagcatgaaagtttggacaatttgcagtctgacaacatgatagaaaaaaaaaatcccattttctgaggtgaaattcaagccagctgcagacatttgcataagtaatgaggagtaaaatgttaattcccaagatcctggggaaaaatgtctccaggccatgtcagagtcatcacagcagcccctctcatcacagacctggaagcctaggaggacaaagtggtttggtggactgggcccagggttcatgtgctgtgtgcagcctagggacttggtgccctgtgtcccagtgactccagctgtggctgaaatggcccaagttagagtttgggctgtagcttcagagggtgcaagccccaagtcttggctgcttccacatggtattgagcctgtgggtgcacagaagtcaagaattggggtttgggaacctctgcctagatttcagaagatgtatggaaacacctggatgcccaggcagaagtttgctgcaggggtggggccctcatggagaacctctgctagggcagtgtggaaggaaaatgtggggttggagccccgacacagaatccctactggggcactgcctagcggagctataagaagagggccactgttctccagaccccagaatggtagatcccttgaaagcttgcaccacacatgtttgaaaagctacagacactcaaggccagtccatgaaagcagcctgaagggaggctgtcccctgcagagccacaggagtggagctgcccaaaaccataagaacccacctcttgcatcaacatgaccgaaatgtgagacatggagtcaaaaaagatcattttggagctttaagattttactgccctgctagattttggacttgcatgggtcctgtagccccttggttttggccaatttctcacatttggaatggccgtatttacccaatgcctgtacccccattgtatttaggaagtaactaacttgcttttgattttacacgctaatagacagaagggacttgccttgtctcatatgagacattggactgtggactttggagttaatgctgaaatgagttaagactttgggggactgctgggaaggcatgattggttttgaaatgtgagcacatgagatttgggaggggctaggggtggaatgatatgatttggctctgtccccacccaaatctcatcttgaattgtaattcccacaatccccatgtgtcatgggaggaacttagtgggaggtgatgaattatgggggtgggtctttcctgcgctgttctagtgatagcaaataagtctcatgggatctgagggttttaaaaaggggagtttccctgcaccagctctcttctcttgtctgctgccatgtgagacgtgcctttcaccttctgctgtgactgtgaggcctccccagccacatggaactgtaagtccaataaaccacctactttttaaaattgcccagtctcgagtatgtctttatcagcagtgtgaaaatggactaatacaacttatgagttgaatttggggtgaatttacattatattgaatgtcaggtaaggagactgaactctattttgtagttcgtaggaaggccagcctagggagttttcatggagggaaaagttaatggagactgctctgttgacaggatgtaaatagcagctgggaaggaaaatgacaacatgcaaaagagtcttttaaagactctagtgaaaatgtttcacatgcctgtgactcagttctgatgatggctgtgatgctcatcatcaaaaaacttgaacttgtcttttaaggtctctatctggtcaacagcagaataacggctaccatggacggttctatgtgtggtcctggatttcctaagaattctcctgatccttgcttcctctgtttctgctctagaagggaaaattggagatcagagagttgaagctacaccttgcaatacagtacagcctttatttacactattaaaaccccttggccaaatggacaaagtgacaggcttagccctttgtatgtttgtccttatatttgcttattcaacaagtattcacagagcatcttcacttgccaggccaggtgattcataaggaaacagagcctcaaggtaaaatccaaagagcatgtggtttgaagccaatagacaggtactccagtcccaggttccatgcttactacccaattgattgctgcctctcagccattcctttcttcacctacacgatgtacctgaccaggcttttcttatgtaactactggaggcaaggtgggctctcttgactgaaagcactctgggaacacacaattttggccaccataaatgacattaaagaatacaacttttgctttagaatctgcgattattgtttgactttagctaagtaagcattttgtcaaatctaacagcaaaagcttctcagtaaaggagcatttcaagaaacctgtgaccctcatagccacaacatttaagatcagcatcaaatattttgtgtaaaggttccacagatgtttgattttttggggtaaggaaactgaggcttacagatgtttttgagacttaaagaattgacacgtcagtctctaaatgaaaaactgcgattaaaacccaatgcttctgcatcaggaggactagctaatggttgctgggcttaatatctgggtaatgggttgatctgtgcagcaaatcaccatggcacatgtttacccatgtaacaaagctgcacatcctgcacatgtaccctgaaacttaaaagttgatgaaaaaaaaccaatgttcctgatttatagataagtaataaaaacaacaaagtatccttttagctgaatgatccctgcttgctaacattgatgaatttagaaatgtgtcttcagttgacctctactcactattatttttaattagttttcttaacagccttaatagtgtttagagcattttatgaaacagtgccctctagtggctaaggatacacttttaaattgcaataacaggtgctatttttagctagctggagaattgatggcgaggctggcatttaaagagatgtattatcttgtggcagatgtgtatattgtacatgtgtagcaaataagcatgaagacagttactgtctggcttgttaactaggtgtatgatttcttgatcaccgacctattaaatcacttattaatatataatcttatcgtgagtgtaaatttagctgcctgtcatttataataacattagcgatgtgacgtatgatcatttgagcaagagcactgctttctgccaaagccaagagcctcaataattatttttaaactgtagttaggtatgatttaaaagagatgtgagtacaagaatagataactcaaggatcaacgtatgggacctaatttttatgaaaaattactcctgtctcattcttcttttcttgtccaacagatcattacaacccaaaagctcaataccatattcctcaaaatgcaaattaaatactgcctctcaaaatagcctttcttaactaaaaatatccaagtttatcttttacaaatttaggcagtttttggttaaaaagacaaaacggtaatggaaaatatacagtatcagggtgttttttttttttgctgtggaatgctattaaaattacatgtttttgaaacttgtcgtttgtggttttaaatcctcaatcatgcattacctaatatatgcatatctgggtccatgcagtcaaagttaccatgttgaaagagattttgcagtttaggaaagtaaggatcataaatgtttagtgaattaagctgacaaaaactattccattttgtaattgcagaatcagaactaggagactgtctcttgactacctggaatgtatgatttacacttgtgttctggacagcagcatctggaaagtctaaatactgtagtctcttcagagacttccaactcagattcctgggattccagagctggcaggatcccctgtagtctggcacagacctctcagcccatactaatccttggcttaattttattctgaaagactttttaaaataaactttttatgttttagaatagatttacatatatagcaaagttgcaaaggtagtacagaaagtttccacatgccccaaacccattttcccctattattatcatcttatatattatgcaacgtttgacacaatgaattaatagtattgatataatgcatcactgttagacaaaatttatgcttaattcagattttcttagctttcacctaatgtcccctttatctcccaaggatcccatccgggacaccgcagtgcatctctttcagttcctcttgctgtgacagcttcgcagaagttcctgtttcttgatttgggtgaccttgacaaaagggtacttgaggaacatgggtcacgtcttttatagaatattcttcaattgcatcatttctgttttgttttgtttcattttccctcctaagtagactgggtttatagggctttgggaggaagactacagaagtaaaatgcctttctcatcacatatctaaggaacaggctatcaacatgatttatggccattggtgttgaccttgatcacctggctaaagtcgtacttgtcattttctctactgtaactacatttttttacccctctttctatactgtgctctttggaaggaagtcactatgcatagccctcacttggagtggaaggcaatgctctttcttcttgagagcagggtatctgtagaaattacctggaattcttccatatggaagatttgtctactctcccccatttatttatatttatttatctataaattatgtatttattatttatttattgaatcatttattaatatcagtatagacttagagatacttatttaagactgttggaagtcattgtttaattgccaagatttgaaaaagttgattttgacaatgtttgcaatctcattgcttttctggaagagatttttggagatcttaactctgctatttggatgtagctcctttttttgtaggattttacacacagttttttttttctcagtttttgttgtgttcagaatggcctgaactctgacacagttgatattggatgatattcttatccctttcaatgctctcaagaattttcagtaaagattttttaagtttcacaattttttgtgctaccaggagaaatgtgtctttagagggtgactattgaatatatagaaacccacattcctgagatttttttgtgtttaatggtatatttcataataatacaactatcttaaaaagaatcacattggcatatttactctgcattattcaaatggctaatgctttgagaaggaacatcctctttataataaaatgagtgctgtcttgtttggcttatttagtatcaaattaatgtgatactcagtgtttcattaagttcctccaaataaccaattttaaagcaacttcttcattctttcatggatataatgctaaaggcgtaaaaagatgatgacccatattatctgaaagagaaaaacatgatttctcctttctctcttaaaattaagatctatatttatgatagcaaaagtcaggtgcttctctccccaccttttagaagctgcttagtgtgatcaggggataactacagagaagcgctatcaaacatttctttctgcactttcagttaggaggatgatgaatgcatacatacacattttccctttctagtagcaatagattaacactgttgggaataattcccctagaaagttttccgagagcctggaaatttcacatcatacttttctagccctgggtcactgtgagtttgccaaagcctccagcagatagataaattggtttccaagtgaacaaagtatattagtcaatctcctgaggcattttttctttgatggccattgagtgtgttaagcagcaactgtatgcccttcataataaaaagcactttaagttgagtgatggaaggctcttgatacttgtggaatgacagagaagttttgaagaaatgaacattagtgcaagtagacaatatttagaaagcataatcaaataaagagttttaagaaaccataatttttttttttactttaagttctgggataaatgtgcagaatgtgcatgtttgttacataggtttacatgtgccatagtggtttgctgcacccatcaacccgtcatctatgttttaagccctgcatgcattaggcatttgtcctaatgctctccctccccttgctccccgccctgatatgccccagtaagaaaccataataagttttaagtcaaagtgagatggaaaatacagagaagggttagtctttgaagactttggagaggtgatttgaaaatcagatgttaaaggaatgcatgggcataaattagcaggacattccaaaccagggctttgatgtgaacataagtcagttatgtgaggaagcagcaggcaagagcaggactggagagggtttgatgtcatctcaccaatcatccacccaataaagaaatctctcagcaacccctggcctgtggtcagccaatctgtgtctgaatgtatcgatcaagtaataatagttcagtgctcttagtgaggaagccagtgatgattgttacatggctctataatattaagataaaatttgtccccagaatgttctatgcttgggttcaattattccttttggagcaactcagaatcaatctaatattttggggaagtgacagtttttcagatcttggaggaagaacttattattaatctctctcccccattcaacttaattgaaagagtctccgattagaaatttgagaaaagatgttctagccccaactctgctatgtattatttgctttgtaagcaaagaacagttaaactgtctcaactatatatagcgtctatttccctctgttccttccctatccagggcttggctctatgaaaagcaactcgaactcttgccttccagcttgggatactgctccaagatagcccccctttagtgaactcctgtctcctatgcagttccatcttgttatcttatacctggattctccatctctgcccagacactacactaatttggatagttttatttctttctcacgttgcaattaatgaggatgagcctggaggtgggggttcctccatggagtccttcagggactggggttccctccagctggtgactgtggtatctataagggctcaaattcctccatcggatactctgtatcttgatggcagactcaagaagagaatggtgaggctgtcacaggaagttttcaggggctgggcatgaaagaggtatgcatctcttctgcatatatttcccattaattcacagtcagtcacttgaccccatctaactgccagagagcaggggaaatgtagcctagttgagtgcctaggaggaaaaagaccaaatgtagaaccagtgcatgtcacttctgcctccacttgtgctagaattcaggcacacagtccccaactaacctcagaggaatttggaaaatgtagtctggttgaaggctaagaaagaaaaggcactaattagactttccaagcttatcagctttagagaagagaaaatagcatagattttctatgttatggagtaaagttgtataatataataatgcatgtgaaaatgcttataatctggtaatgtggcataaaaatgaatgttaatatctttttttacaaataattctggacaattagacagccatgtgcaaaataatgaagttggacccttacctcacaccatagataaaaattaactcaaaatggatcaaaaacctaaatgtaagagctaaaactaaataatttttaggagaaaacagagggataaagctttataactttggatttggcaagattcttagatatagtacaaaaagcaaaaacaacaaaagaaaaaatagataaactgaagtttatcaaaattaaaagcttttgtgtttcaaaggataccatgaagaaagggaaaaggcaatctatcaagtgggagaaaatatttacaaataatttacctgttgaggaacttatatccagactatataagaatgcttaaacccaataataaaaagacaattattccaatttaaaaatgggcacaaaatctgaggagacatatctccaagaaagatttacaaatagcaatatgtacatgaaaagatatttgacgtcatcgttcagcaggaaaatgcaaatcaaaagcacaatgagacactactcccctcttcctagaatggctacagtaaaaagtcagataacaagtgttggtgagaatttggaaaaaacagaaccttcacgtcctgctggtggtaatggaaaatggtgtaaccactttggaaaatagctgggcattttcccagacaaataaacatagagttatcctttgacccaacaatttcattcccagctatatacccaagaaaaatgaaaacatataaccatatacaactaattacactaatgtttgtaataatattcataatagccaaaaagtgcaaacaacccaaatgtacatttgtgtaatggaacattatttggccataaaaagcaataaaatactgattcctgctacatgctacgtactgattaagtttgaaaactgtaagacagtcacaaatgactacaatatacatgattccttttatatgaactattcagagcagagaactctatacagacagaaaatgggatagtggttgcttagaatgggggtgaggggcatgggggcaaagaaagtgatagatcaaagttaagggattcctttttgagattctgagaatattctaaaattaattatgatggtgggtgcacatgtctgtgaatacgttaaagaccattaaattgtgcactttaaattgatgaattgtatggtgcgaattctatctcaatgaagctgttaaaaatgaaaggtaatatatgcattattgttaataagatactggcctacccagatgaaagactgtgcaacactcatggcaggtccttagaaaccaagttctgaccactcaaccatgagaaatactaatgaggaagaaatagaacaagcatctccagcaaccagtgtactagtctggacagctttctgatgatcttgactttaagaaaaatgtatatacaaatggagctaacctcagaacttaaaaatcatgccaagatgaccaagatccaagatgatgtaaagcttgtaagaagtgtaaagggaccaggcacggtggctcatgcctgtaatcccagcaccttgggaggctgaggcaggtggatcatgaggtcaggagttcaagaccagcctggccaacatagtgaaaccccatctctattaaaaatacaaaaaattagccgggtgtgatagcaggtgcctgtaatcccagcgacttgggaggatgaagcaggagaatcgcttgaacctgggaggtggaggttacaatgagctgagatcacgccattgcactccagcccaggtgacagcccaggtgtctcaaaaaaaaaaaaaatagtgtaaagggcattgaacagaactgccaggtaatattggagcaagtaagagggtaaggaggttgaacaactctgaatacactaaaaaccactaaattatatacctaactgggtgaatttatttgtatgtgaattatatcttgataaagcatgtgcttgctcttgctctcactctcgtgctctctctctctctctctatgactctcttacacatacacacacacatgcacacacacacacacacacacacacacacacacacagagagagagagagcaaggaaaagatagaccctggcgtggaggaggtatgcaggataaccatgcagtaaatattcttgcatgttctccagtaaggaatgtatttttcaaaattgaaaaggaaaattcgatatcactttcttaggaagggagggaagattgttcaggaaatagtgagaacaccgagctgctcagggagattcacctcaatctaaagtaaatttgagatgggataacataaaaataactaggtttaaggtactaggacaaaacatctagcatgcattatctcttttaattgctcagtaacccagtgaagtaggtaatatcattatcacccattcagagaggttaagtaacttattcttagtcatgcctgtagacaggatgaacaccagtttgaaaaaccctctctctggctctgggggcaaggtgaaagcccacgccatgtgtttgagaattcagcgcaggtaaagaaatgtttttttgcattggtgatattttatttagtagtaacactttattcctaaggcgtactagttgacttgtcaatgaaattacagaaccattgtaaataatctgtagaaatttgcaagcaaatgagaaagcagctgaaagactgggaaaaagagatgattgttttagttgtcaaaaaaggtaaatctataggactagttcataactggcaaaattctagagccatttaataaatacaagtatgtcctgtaaagcggtttgcatcctggtaacacctaattgtaagccatacaaatactccattttcctaacttatttctagagaatcaattatgatcttaccatagtgttatcttaacagcttttatactttcaaatgaaatggatttattcaaacattagttggtgatatactttttatcatgctgtaaatgatcctaatagaatttgttaaaacatttaagttacgagtgaagcacagttttctagatgtgtgctggactaacatttgccataaactatcacataatcagttccttgattctttatggacctgaagcctacttacataaaattggtctagtaactaatgataaagattaaataaaagtcattgaggtcattgacagaaggctatgttttcctctaaaatcatggcactcaattcataaacattattcatttttcttctaacttgtatatacttttagatgtaattgtgtttcaattttgattgcccagctaatcggaaaagctttaaacctcttaaacagtttctttataaaagcataatgacgtatataatggctttcagataatcctgtcacagaaatgattatttttctctattcctggtgaaccaaagtgcccccatgtgcttctacgtgtaatgttatataaagcactttgaagcacgctgtattatttttcatgacagtatcattgataattctaatggtaatttttccttcacacttggtagcttccaggcataatgacacatcactaaagctttgactgttaaagccctttgctcatgggtgaagaaaagagaatggcaagttaaaaataatgacttaatcctcatttacattgcaatgagttattctcatttgtggaagagggatgtcttcgatggggaggataatgaaggcgatgagaactatcagaccttttgtgcccgatcaataggtcccataaataaaatctcaaatcacacactacaaagtggaaatcatgtgtaatgggaagggagtgaaatcatcatcttagggatggcaagttcttactgagaaggatgacttcatgctggacctcttgtggtttccagagctgtagatgaataaattttcatcccttgattgataataaattttttgaggacaaaaatagttctagattgagaattcagtcattagactagactcaaggggacatactctagggacaactgtgggagaccatagactagacgatggctttcttacctgcaggaacaggaaaaaccatcttcaattttgtggtctgggagggactgtgcctaagcaatgagaataaaaatacaatctattctattgaaaaggtctttagagcatccttccagtaatctaaaagtgtgacaccccaaatacactagttctttcattattttcttcttccttctctttatcctgaagcccttaagtctactcaattatagaatttcttcataaatgacttatagggccatttttgctgggaatggaatgattttccatatcttctattccatcctacctaattttagtcaacctgaaaccactgctttttgtgaataacgaatgtccaacagaactcccaccaacctcacagtcccagacatctgcattactgtgggtagtcactcaaatgtagctagaggaggctttaccagaaaagctaattgccccaaactttcctcttggaattagagttgagtttttgttggtttgttttttaatgtgcccaattaatcttttattggtgtgggacaaatgttgagactaacaagaagattttggataagtggataacaatctcgcaccctacatccctccttcatgggggaatgtaagtgtggattgacccaaagcaggaactctaggggtgaagcaaggactcagctctgccttttcatcagctctgatcatccattagagatgtccaccctgggaaacatgggaaaattttcacaccacccaaagccctgcactgattccaccacaagctcccagtggggtctgggccttgtatgtcaacacagcaagatagctttgtatgaggacagtttccttcccaccagacgttagagtcatcctaggaacaactgtccaaccctgggcacgtgccacccagcagcacttctgaatatgccactgaggggagagatgaaataaacacctactcaaacccatacatctttcttaaattagccacaactaatttctttcatgctgatttttatttctaaagctgtgatttccaaagccataaactttgggtctgaatgaaattaagaagggttagagggctgggcacggtggcttatgcctgtaatcctatcactttgggaggccgaggtagtggattacctgaggtcaggagttcaaggccagcctgatcaacatggtgaaaccctgtctctactaaaattccaaaacaattaggcaggcatggtggtgggtacctgtaatcctagctgcttgggaggctgaggcaggaaaatcccttgaacccgggaggcagaggttgtggtgagccaagatagcaccactgcactccagtctggccaacagagcaagactccctctcaaaaagaaaaaaataaatgggttagaaatacagctagacgctaattcagaccctctccttctcatactttccatcaaacccatttttctttctcaggaattcttttttttcaattgctgttaaatatataatataaaatccaccattttaaccatgtaaaagtatatactttagtggtacattcacatcgctatgcacccatctcctccatccatctccagatccttcctactttccaaactgaaactctgtccctattaaaactaactccccattcccccagcccctgcacccaccattctacttcctgtctctgtgaatttgactaccctggggacctcatgtcagtggaatcacgcagtatttgtccttttgtgactggcttatttcacttatcataatgtcttacgggttcatccatgttgtagcctgtgacagaacttccttctcttttaaagctggatgatattccattatatagacagacaacattttgtttacccatttatctgtcaatagaatcttggatggcgcctactttttggccattgtaaatgatgctgctatgcacatgagtgtacaaatatctgttcgagtctctgttttcacttcttttaagtctatgcctagcagtggaattgctggatcaagtggtaattctatgtttaatcttgaggaactgtcataacatttataagaagctcttaatatttccagaaaccatcccaaatagtggatgagccaagaagacaaagtcatttcaatgccattttgacactcaagaaattaggccttaaaatgcttaatgtacaaaagaacaagcaatatacacttgtctctcttcaatggaaatagagttatttctgtgtgagagtctgttactacattctgtggaagtggctggagagtttacctggcttacaaagtctgttttgaatggcctgtcataaaatttgcatttggggactctggcgtggcacttcaaaaggtcagccaccattctctggaataccatgtgattggagaagcagattgtttccttcctcatggaataattgtcctgtcctccctggtgtgctttctacaacaatcagggtccaccgtgcatgagaggccagaggacctagttctgggccatggactagattcctgacattgggcatttactgtttctgagttccttcctaccttccttccttccttccttcctacttttttcccttccccttccttcctgtctcccaggctggagtgcagtggtgcgctctcggctcactgcaacctctgtctcctgggttcaagcacttctcctccctcagcctcctgagtagctgggactacaggcacgtgctaccatgcttggctaattttttgtgtttttggtaaagacagggtgtttcaccgtgttagccaggatggtctcgaaatcctgacctgatccgccctcgtcggcctcccaaagtgctgggattacagacgtgagctattgcgcctggcctgtttctttatgagtaaaatgaataagcttgcatgtgaagacaaccccaagtctcttccagctctaagttcccacagtgcacggaggcccagatgatcactgcaggaataggaaaaaccatcatcaattttgttgtgtgggagtgtctgtgcctaaacagtgagaacgaaaatacaatctattcattgaaaaggtcttcagagctcagtaaattttgccaaattcgatccatggtatacattacacctactaccttttctgatttcttttctctctttttcctacaaataatcactcttcctcaggtctggggatagtccagtgaacttgacagagtcttcaaggtctttcctggggccagactcttgcggcaccagctctgtttaatgtaacttcacaaaactgctccatagcctgacttcctggaagggtgttttcctgctttcccagatgaccagaaggacttcctcaatacctactccgaactctgctttttttttttttggtccagacagaaacataaaaagagaggtgcagcattccaagatgcagggagcgcaaaggactgggaatgtcaggagaccatgcttagccacgcaggaaggcgctgaggaaccgtgctactgaaaggagaatgagagctgagccccaggggaggcatctgcagtctcccaggagaaatttctcacatgcactgactcaagaaaatgtgacgtataatcatgaaagacatatattatacacaccatggctgattcctacgaaagaggaaaacaaccaggcaaatctatctgggaagcacaattataatatttattcacttgagtaggactctatcctctgatttaacacatggagtgaggacataagactcaggactgggatgagaaatgtaaggtgcatgaatttcaaaaataataaaatgaaaatatttatttgcttatggttcaattacgtggaatagaagcataagcagaaatcaaatggtcaaacttacaaaatctgctcttctttctgaacagtgatcaatggcctcactgaaaggactcagggcttggatgtctctgtggggtagtttattctagcacttgtgtgtgttttgccttggcaacacggaccaaggcaccagaatagcacacagcagctgaatgccatctcgaattttctgatttcactcccaggcttccagtcttttctgttatctttttttattttgaaatcctcattatgtgtttgctatatgaaagcacaccaaaatgtagcatgacacagtccctcccatgaaagcagaatgacacatggggaaggaaaaacatgatccaagggctgggagatggtgaagaaagtgctgagtgtggaccaaggtcatcacttgcctctgtagctcccctggcaggactggacatgtaggaggcacccccacagtcagtatttatttggtgttctaggttggaataatagtgtgattccattcaagggaaaggaacaaaatcagatcccagttgtaacactcattgcagcattttccttgagtctggggcaggtgtgtccagcgattctgcttggagaaggagaagatcctacagatgagcttctccacagggtgagagttgagcacccagcacggtgtctgcacagaggatgacaaaaatcttgaatgaatgaatggagttgaataagcaaacctaggacagggtgtggaaggtgaactcatggttcataaagtcagatactttggcattagtgaggtaggcctgtgtatgtgagtattcacacgcagttgtttctgtacttgtatgagagttactaatgttgatctagttgacattgtttagttcctagcataaataaagtatcatgacattgtttaagggaagaaaatttactttgtaattctgtggtgttgaaagtagggaaagaaatatgttgccttttaaatacacagcagcgctctcatggagatcacatggaaatgacagcggtgttgtgtccggaaagcaaaagcaaaacaaaaacgagaaaaaatgaaaccaacagaacttgggcacttaagaaatccatttcctaatggagtaaacagatatcgcactgcaagttacaattttcaacatcgtttaccctacacctccaccattcggagaggcagctctaataaatgagatgcagtgatgacctttaccggctccaccgatagctataaattgagctgaacattcccatcagctaacaggacagaactcattactgactgaagattgctacgatgcctttgactgagatgtgtaccattaaaatgaatgctccttcactcgtaaaaacaatgtcttgtaccgcagaagacctgatatgccattcattgatttttgtggatgactacaagaacaacccgtaaagattagctgagtcttactgtgtgttagttaaattatgattcagatcaatttgttcttttttgagagagttgattttttgtttcttaaattagaacctttgtcgatggcatgcatggaatataattgtcagatttacagtcctgatgattcaagcttagataaacacttgttccaaatacattaaagtaaaacttatatccattaaactaagtcaggattttgaatttttaaagctttgggtacatagaaaaaatttggttttgccgatttttttggcaaaatgactctgactttgagaacaaaccagtgtccatgcccaggtgacagcacttgccctgctgtgattattaaagcagccccttgcactgccaagtgtcctagtccagatgatgaattgcacagtcttattggaagtatgtgaaatgggaggactgtagccatacttgatctctaggatacacttttatcaggccctacaggtaaagtattcccataggccttgtggattttcacaggaaggcctaagttactcagatgtctgggagttgtccctggttggtttctgctaataacattagtagtcctgacgcttcatacttagcaggacctaataggtgaacccagatatggttctaatgtcatttaagttattaattgacattattaatatccccattttttttcagatgggagtatcaaggcacagaaaagccatataacctgtctgaggttccacagttaatagctagtaagcatgggaatttcctaggactccaggttagggaactacatcagacacgggttctcatttcaccaggaaacaaatgcgaggacattcttacttccacttactacaatatattaatgactagtgtgtgatgatacctccacccactcggagcttagagtgataacccggttatcctgcagctttcagatgatgggttctacctctctaattgactagactttctctaataatactggcaaagtctttatgggtcaaagtcagaagggaaagagtctctagtcagagccagagtcataagacacagtgaatgtatactaatgatgccacttggtaaacttccagcatgttatgctggaggaggctgggaggcagtctgtccctctgtccctctgtccttggtggcacagacagccccctggagccagccaaattcagactcacattctgcctaaggcagagggacacaggcagacacacgctaccaggagacgtctgcctttgacatcccacgtttgtgacacatgccagatcttctcagaaagaaacagtgcaccacagccactgtgccatcaggcactttgacactcacagacataaatgggcaagtcggaaggagtagatgattccctctaagaggacctgcctacttttcctgggagagtgaagaaacctctaatcattggtttctctgtttttccaacccaatgagtagacagaattgttccatgtaatgatttttcttctctctgtataagacactggccttcctgctgtttgcattttggattattttgtttgcttttaagtcagaaggacaagagttgtgtatagacaagctttatcatagattctacctaaaattcttctggaatatgattcagttttttcctttgtaaataaaatcataggtgaatgtgtggtcaaaaggtgtagttggttttcccctttcagagatctgagtgccgctgggggaggtggcatctcatatttataaaacatgttatttattttcttactttcaaaatgctaaacatagctgatctcaattaatcagcacagtaaccctttcagaaaaataaggtattctattactgaaaatgaaagactgcaaggtaaagtaactgctctcaaaaaacgctgcaatgggattagaaccaaattctcctgattccaaagccagaagttacagtcagagtatgattgtatttctttattaagattaaagtcagctctcagcagcagaaagattaaaataatactagtttaagaaagatggaaatttacttgtctctcaaatttatttattttccacatataagtccagaggtggaatctacactgtattttgcttttatcttccattttcatcttttgcttttatcttccaagatcacctaaaggaacaaaatggctgctctagctccagccatcataaaagccttcctgctagcagatatgaaagaggagaggggactatcatgctctatccctttcaggactctgctttagaggttgcactgcatacttctggcatagccagtctgtggcaaagcctaaaatagaggccaaatttccagatttttggaccaagctctttccaacaatctgtcccttacgcctggagctttttgtcaccgttgtgttgatgtaatctttggtcaagtttctgtctctcagcctatccattagtctttgctagtaggaggtgatttttctcagggatgcatagataaggtaaggtggaggcttggctccattggaaatgctgaaatgaatttactgcaaaactagtgttttctatgggagtgggatggggcaggaaaatctattgcatctccaccagccagaattcacttgcgtctagtaagacctcctcacatttccatcagtgtctacaacttacagagtcacaaaaagctcggagacaataggaacagacatcaaaattatcagtaacgcaaaatataagtgcccatataatgcctaatataagtagcatgtaccggacaatgcctcgtattctactgaagaaatagccagtgatcttctggcggcccatttcaaagtcttaaatttttttgacaccttcagtaatacttgttattgatttgctctaagtgaggttttttaaataatagaatcatcataatccctttagagatccttcaaaaaatcttagatttatataacagctaatcataagaatccttaacaatgtgtatatgcgaagtccttttgttcgttatcaggaaagggcttggctgataacacatttctgaggatattcattcctggataaatttttaaggatttttattctttgctgatctttatttcaccttcacccctctcaacatttgaaagcctacttaactctatattttcttttatgttaggttcaagtgaaaaaataatttgcaaaaacaaatcctaattctacaaataaattgtttttttttttttccttaaccatgtagcaggtggttgacaatattaaatacagaaagagggccttcgttgtttcagtggggtttcagtgtatcaagctgtttaaaagtctaaacaggactctgttaaggcacataaaaattgaatagaaaataatggaaatgtaaaagattttaaaagctatttgggcaatgcattaatcaaaggcaaattgggcagtctcagatcttatgattaaaaattaagtgaaattgaaagccactaaagtcatctttgaaatgtagctacttcccaaataatttccaagctgtgattatttttttgaaagtacgaaagtacttatcaatgtcattactgacgttgtaaaaatagatattgtggtatcattttaccgtagtttgaagtccacagaatgtaataaccctcctctcagtctatccacacacgcttacccatttcagccccagacaattctccacctttgtttccaaggtttagggtttctaaagcaaatgcctcctaataacctcagacttacaaaatacagtacctggttgcattcttgaaagggggaagaaaaatattacgtggtctttctaactcttttttttttctttgagacggagtcttgctctgtcccgcaggctggagtgcagtggcgcgatctcggctactgcaagctccacctcccgggttcacgccactctcctgtttcagcttcccgggtagctgggactacaggcacctgccaccacgcccggctaatttttgttgttgttgttgtatgtttagtagagacggggtttcaccgcgttagccaggatgatctcaatctcctgatctcatgatccgcccgcctgggcctcccaaaatgctaggattacaagcgtgagccaccacgcctggcctcattcttattctcaagatcctgcaggaaaatcaggtgtagtgaacctcccagtcaggttatcccgccacgtatgttaaagttgccagcgtaagttggaatcaagaggcctgcgtgaggcccttgagccagagggagctcattaaccagccagcaattctaatgttcacatctcacttagggtcttggagaagctgggaaatctccaggtctcgggagcacgtctcacaaatgtcaaggctgtaccaccttggttaagcgcttactggcagggccgctgaatgctgtttgtatttagaatggaaagaaatattactagaaaacttgctcttttgaaagaaacctttgtacctctttggagcccacattgccttcctctgacaatttttgtgaggtaaaccagaaagcagaaaacccagacacgagaaaaaaaaattggaactctgtctcctccctccaggcctaatcctacgtactaaactgcagccccgctgtagagcttcccagcgtctgctcaggagccccctgaactgtcttcacctgtacaattagtgggtgttatgggaacgtgcacctctggcttcccaccttcggtatctcccacttcctgtacttgttttacctaaacacgagaatagttgctcacagtttagtctttctcaattctaccctcacccaacgttcccccaaaacccacctctggggcggggatcgccttcctgatcatccagggagaagcatctaggctgttttgagtcactgctcctcactgaccgagtcattcccaagtggtgcctgcactgtggacaagagctccaaccctattgtacgtttctagaaatcagggattatgtggtcttattttctgctccattttttatgaaatattttaaatattttcttgaaagggggaaggaagacattactgtggtctttctaactcgttcttttcttttttttgagacggagtcttaccctatactgtactctacagaaaagtagaaaacatatttcagtgaacacctatattaccagtacaaatgccaattaatttcaatgccttggccatttttgtgtcctccatcagttctttttttgctgaaaatatgtaaacataaattatactctcattttctttcatccctgaatactaaaacatgcatctccaaagtgtatcttcccatacatccacaggaacatcattgtatctgacaaaaacgaccataatccccaaatatcattacattcccaggccatattcaaattcccttattcagtctcaaaatattttctgtagcttttgttttctttaagcctggatcaaattaaaaatcataattgtacttgattatgtcttttacatttctcttaatggtagaatggctcctcttttttctgtgatatatgctatttcacaatacacctggattaggccagttgtattgtaggccctcctgcattccgcacttgactgattgctttcttgtgaggtggtttcacaggtttatctataatgtctacttgtcccatgattggtgattcgaaggggagattaatgggcaaaagaggtgaccaccaaatttctctattataaacatgtttttcccattgagaatggcgtattttctgtgggataatatcccattaacttttctccaaatgaggttagcatccatcattgatccttacctgcaccaagttttacgacaggggctacaaagcggtgatgttctgaattaatcacctcttctacacttacgagttgacagtcttctgaaaggtggaactctccttcataaacaggctatttggtgtacctgaagtaccaacaaagcaggcagctgaatccttgtctgtttttaattattagttttcagattaagaagttgatatcatagttatgttcagctatggaaaataaatagttttgttttctttaatgttttgtgagtatcactattgacttgtgctttctaaaatgtattcactgtgtcttcatcaccgatagcattattcttttggtgtttggattgtcctaactttgaccatggagagcccctccagagggttattctgtccttgtgtcagttatctaatgccacagagtgctgtgtaataaacaactaacaaccttccagaacacatagaataagtcatttttcacaaacctggctgttggcaggtggtggttagggaactccacgtatctcatggctgatgtgctcacatggccagacacccagctggatgttggctgatctggagtggcctcttcttggatgactggagcaactcggtttgttcttcatgcctttgatccttctcctgggccaggacactagaccaggcatgtttgtctcatggcaatagcagaacccaagagaaagcaagtccactgtgtaagagctttttaagcaccagcccgcttctacttactgatattccattgcccaattctagtcctgtgtctgagcctagagtcatgagaaaaggcccggaaaaattagatggaaaagggtggggtgaagaattggagccatttacaatctaccatggtcttattgatgtgtccttatcagtcacttgtctcccccactggtctttgctttctggccagtaagatattttagatttataatatactttgtgtgcctcagacctggaaacatccattttttcaaggatccctggctcattttggggagaatggtactcagagacaaaaatctgggtgtctaggataatcatgcttctagcccgttttcatggacaaaactagcaagtgtgtagttttgaacaataaagaaacattggttcctattgatatttctgatgcaaattcaacatcacagagttttaaattttaactgaatttccttttgtttgttaaagacagggtctcactctgttacccaagctggagtgcggtggcacaatcatagctcattgcagcctcaaactcctgagctcaagaaatccttccacttcagcctcttgagtatctgggactacaggcaaataccaccatacccagctaacttttaaattattttttttgaagagacggagtctggctatgttgcccatctaatttttcaggctctcaaactcctgggctcaagctattctcctaccttggcctcccaaagtgctgggatgataggcatgaaccactgcacctggtctgaatgtccatgattaaaaatgtgggtctcttttctcttgtacagaaaatcttagctcctaataacattaacggaattgtttattttcttggaatgatgtctgagagcacaatgctgtgattaacacggaatgctaccacagctaatatgcagtaactgtcatatgattatcagtttcattaaagtcagagaacgtggctaacacatggtccataccaaatatctagcagagcatcccgtacattgtaaatattttttaatgcataaaatgtctattggttttgttgttttgttgtgtttttttttttgagttttgcttcttgtacctatcatttctctttttggaaacacctaccttttctaagcatattctcatgcaaatgagttactgatctactttaagcagaatgcacataatttcttttacatttcctcaccgtctctatgtgtagtatttccttgatatgctaaagggctgtgtgcagttctcataatcccaaagaaaaggatgtagttatcatgttgcgtactttttaaaaatatcatgagttttaacaaaacctaaaaaccagaagaggctttggcatttccatggcattcaaactcctactttttaatccattgattctgatgacgattactgaggctcctgctacaatataagcctgcattcttttttaaggtcttgtgacatttgggttatgctggaatttgtttttaactatttaaagatttcctattttgtcccacagtggttgtcttctttatctttaagataatatctttaacactgaagacattattggcaagaggaaggtctggaggtctgctcaccacctttggtgttctcttccatagccatggcctgagaagggtgatttttccaggtgaaagataggctgtggtgtaaactaagacattccaaatgaaacataatcacttaatataacctcgtagatagtgctgtccaaaagaactttctacagtattggaaatattctatacccacagcatccaacacagtacccaccagctatatgtggttactgagaacttgaaatgtgtctagtataaatgaggagctaaatttttaatgttatttaattttaattaattttaatattaatggaaacatgtggctagaggctacatattagcagtacagttctagattataaatatggtccaactaaaatatttgcatttgactcatgtttcctgaaagaaactggcagtaggaattaatgtcagctttctaatcatttttgattcttcttataacttgccatacacaccttattgcttaagagccaaaggaaaaatcactcttcatgagaggcagtgtatctacatctggactgaagaccttcatttggctgctgtgagttcataggctcccagctcctgactttgcagcgaaaaatttcagaattggagcttgtggcccagtgattattggagaaacatggtgaaaacacaatcactaatagcctgcaactgaaatatcagattaattctataaacacaaattactgcagaagcccaaaagggatgaaatgaaagacaggtgcaacagacctttatttacgttatagctgcatgatgtttttaaaacttcttgaactgtaaatgttaatagaaaatgttaaagtagaaagaatagtaaataaacctccaaatctgtttgttttttaagtatcattttaagttcaagaacttatgcatagtcgatgagcttcaatcttttgcagttattagttttatcaatgctccaattgttttattcttggccagtgggagcctctccaagatggcttctgagtcattttgacatggtcctaataaactttgacctttgggctcagatattgcctatcacagacatggaattagccatttacagagagaatctgggtttcatttagtgggaaatggtatttctagactgcagtgtggatactggagattacagattaatattttatgaccataatattgatgttgactgtcttaagatatgtgtatgttgtatgctatttgttatcagaacatacataaatacaagtaaattatagatagaaataaaataaataatagaacactgtttctattgctagttatttaaaactaaaagaagatgataggagaaaaattaaatttactacattcattgtgtatactctttgtttcagaaattaaaatctattactatgtagggattctttgtgatatttatacaatcagggattaatgtactcttcaaaaccaaacagcatatataaattacacttagtaatgagatttgttagctcaattgttaatgaatctacagtaccataagatgccataacattatttaaatttttaacatacgcatggtcttcaaaagcctttttaaaaatgcattattgtcaagcaaaagtaaacaacatataaaatcagctgatctatgatactatgagtaaataactggcattttatctaattgttgagagagttagaaaaaataatttgttattgttatatcagtttgaaaaaaaaaacaaaaaaggaatcatcttcctagtcctagctaccaatgcaatttttttccatttctgtaatattttcagcttgaagaatcgcataggtacacaggaaaatgagatgagtggcatattttaaatgcaaagcactagatatattgcacatgaaaagtaactagcaattggtggtgctgtaagctttccttttggaaattttctcctaggaatctgacattgtatgtttcttagaactcccattgagcatggcttttcaactttatctccctatccatatagcgttaaaatgcactctacactcccctatgtaacatcttattgctttgcaattataaggataaaataacgataattgaatctcataaagaggcacaaaaggtataatttgacaaaaaagaaacaccatgcctacgcctccgtccttactccacctctgtcatggcctcctcattctagagcagttactcttacactagtggttctcgtcattgttttgtatgtaaggtggatatttggtgacttagacttatgatagtattaattggctcaattcctcatacatatatttttcatctaactttgtaccagtcattatgctaggtattagagatagaaaatcaggaagctgtggcctcttctctggcgaatcatgtactctagtgcagaagacagagagttattacaaacaaataactctatcatgctgtgatgaatataaaataggatgaatgaagtatggactgaaagcagagagagattaattctgcctggaaaaggcatgaaaactgtacaagggagttggcctttatgcagatcccaggaagatcttacccggccatagtgggagaaggacattacaggtgcagggagcagtgtgagggagtgcagaggattgggagacatggtggtgctccagatgctttgttggggtgataggcattcaaatgggaagaggggccaaggccagaatcggaaggaccttaaatgtcaggctaagaaacttgactaaaatagtttctgccaaagggataaaaaggagttttaaaagagagatatggctttgtctgcatagagaatggaaataaggagagcgacccattaggaggctgctggagtagtctatggtgaaggtgatgacaatcagaaccaaggcagaaacattggaaatgaagaagacaggtgatttgagaaggcttcaagaggaagaatgggcaagtcaggaaataatccagagaggggatccccagtcactgccttcccacattgctgaatgacctgtgaatcatatctgtggcagggaatcaaggcaggtcagctaaagagcttaaacatcttcactaacaacactaacaacaaagctgctacccaagaaacaaacttggctgtgtaagcctagcaaagaaaattgcctgctagaacaaaggaaatcacatttatcgggagataatatcaaaacccagaatgtccagaaattaatatccataatgtctaggatataatccaaaattacttaagatacaaataaccaggaaagtggaacacatgctcaaaataaaagaaagctaatcatttgacctggaaatggaacagatttctggaactgacaaagattttttgaaagctattataactatcctcaacgaattaacataagcctgttttgcaatgaatgaaaatctcagcagagaaatagaaaatctcagcagaaaacataaaggaaccaaatggggacttataaatagaacaataaaaattctgaaattaaaaaattcactggatagacttgataatttaattaccatgacttaggaaagattaaatgatagatcaatatccaaggtgaggctgggagtggtggttcatgcctataatcccagcactttgggaggccaaggcaggtggatcacttgagatcaggagtttgagaccagcctggccaacatagtgaaaccctgtctctactacaaatatgaaaattagctgggcgtggtggcacatatctgtggtcccagctacatgggaggctaaggcaggagaatcgcttggacctgggaggcagaggctgcagtgagcagaaatcacaccactgcactcagccagggtgtcagagtgagactctgtctcaaaagaaaaaaaaaaagaaaaagaaaaaaaagaaggaaattattcaaaatgaacagggagaaaatttgtttttagtgcgtcagaggcctgtgaagagatatccatctgcccaatttatgtgtaattaaaattctaggagagaaaatggataaagaagtagaaaaacaatttgtcaaattaacagctaaaaatgtgatgaaagacataccttggcaaatacaagatgctcagtgaacatcaaacaaaataaacacaaaacagctcaatctaaagcacatcacatcattagaggaatgcaaatcaaaaccataatgagacaccatctcatgccagttatcccagaacttgaaaaaaaaagtcaagaaacaacagatgttggcaaggttgcagagaaaatgtagcacttttacaccttggtgggaatgtaaattagttcaaccattatggaagacagtgtggcgattcctcaagatctagaagcagaaataccatttaaccttgcagtccaattactgggtatacacatgaaggaatataaatatttctagtataaagatatgtacacatgtatgttcactgcagcactgttcgcaatagcaaagacatggaatcaaccctaatgtccatcaatgatagactggatcaagaaaatatggtacatatacactatggaatactatactatgcagccacaaaaaggaacaagatcatgttttcttcagggacatggatggagctgaaagccattatcctcagcaaactaacacaggaacagaaaaccaaacaccgcatgttctcacttataagtgggaagtgaacagtgagaacatatggacacattgcagggaacaacacacactggggcctattgaggggaggcgttgggggagggagaacatcaggaagaatagctaatggatgctgggctttatacctagatgatgggtcgatctctgcagcaaaccacctttatacctaggtgataggttgatctgtgcagcaaaccagatttacctatgtaacaaacctgcacatcctgcacatgtaccccagaatttaaaataaaagttgaaggaaaaaagagaccaaaagaataaaagcacataacagtcagcttcaaaagccaaaggcagcacgtaaatcttaaaggcaccaaaagaaaaataatacgctctgggaaataattcaattaatggttgacttctcattaaaaaccatggtgaccagaagagagtggaacagagtttcaaaatgctgaaaggcaaaaaacaaaacaaaaaaccctataaactggaaatctatattcacagaaaatattcttcaagaataaaggttaaatgacattttcagataaaacaaatataaaataatgtgttttgccagcagacccatacaaaaagaaatcctaagggaatttcatcacggaagaaaatgatatacaatggaaactcaaatcttgataaagaataaaacacatcagaaatggccaattgtggataaatgcaaaagacatttttttctttttgactttttaattttaatttctttataaaccatgttgtgtcataaactaaaactataacattgtcttctgtaatacgtaaattatgttgatgtaatacacataacaagtataattgcgtggaagtggacacggacctgaaagcttaacaggtttctatagttaataagaagtggtacattattaactgcttctggactttgaaaatttaatggtatatattataacttctaagacaaccacaaaaaaagctaatgcaaagaaatgcaactaaaataggaaaattaaaattctaaagatatttaaacaataaaatgaaagccaaataatgagagagaaacaagacagaggagacacttagaaaacaaacaaacaaatgataaacccaaacccagccatataaatggttttcttatatgtgcatatggtatatttaaaggttagactatattattatccataaaaatgacgtttcaaaagactgaaatatatacagagtattctttgatccagtggatttaaattttaaaaatctataacaataagatggtcagataaactttaaatatttggaaattaacagatttcaaaatacctactgggcatatgagacatttgagggaaaattggaaataatttgaactgaataataatgtaattgagcatatcaaaatttgtgagacgtcactaatgctatacacacaggaaaaattttagctttaatagtttaactagaaaggaaaaaaaatatcaaaccaaagacctaggctttcatcttaacaagctagaagaaaagaagtaaattaaaagtgaagcaaaaagaaggaaggaataacaaagaaaagaaaataactttctgaagtagaatacagaaataatacacatgataatgccaagagcttgttctttgaaaggtcaataaaattggtaaatatccagtttggtcaagaaaaaaagaagacacaaatgaccaattcaggaaataaagtagggagataaatgcagatgccacgatcctactaaagcataacctgttatcttactaaaaagataatatgttattaattaatagaaaatgcatgcatattttttaaattaatatttttaaataaataatttatttttaaaataaaacaaaatttatactgatggggttcaggatatactaccaaaaaatatggcaccttggcagtggaggaaatagcagaaacaaaggtctctctgcccttcctccacacttctcccctaaagcaggtcatgcaagaatcctctgactttcttctgaagaaggttacaagactttcattctagaagtgtcattcttgtactcagaagaaaggaatttccttatttcacaagacacagggacacaaagaagaatgtcaaccaacaggccttgctaagttccccatttattaccattagatcacatcacctttcttcaattatacttctccataaatgtccaccattcatcaaaccaaagcataaaaatacacaggtttccctgtttctttggatgttcctgtctgaagtttcccatatcacataaaacttatgttacataaatgtgtatgtttttctcgtgttgatgtgtcttttgttgtaggtgcctcagccatgagaccctgatggtgaatgagaaaagatcttttctctcctacaataccaatacattttacaagctagatgacatggacaaatcatcaaatgactcctattttcaacaccgacctaagaagaaataggaaactgaagcagctctatttcggttaaagaacttgcatctgtaatttaaagccttctcacaaagaaaacttcatgcccagttggcttcattaattaattctatcaaatatttaaggcaaaaataataaaaacccaacataaattttttcagaaaatagaatagaatggaacacttcccaacttattttatgaagcagaaatactctcactctaaaaccagataaagaaatcacaagaaaaaaaagaattaagaccaatatccttcatgatcatgaggcaaaaatgcctggcaaaatattaacacataaaaatcaacaataggcctggcatggtgcctcacacctctaattccagcactttgagaggctgaggcagaagaattgcttgagctcagaggtctgaaaccagcctgaataacaaactgagacttaatctctacagaaatttaaaaaattagccaggcatggtggcatgtgcctgtggtcccagctacttgggaggctgagttgggaggatttcttgggtccaggagttcatggatgcagtaagccatgatcatgctactgcacttcagcctaggtaacagagcaagaccctgtctcaaaaaaaaaaaatcaatactatataaaacatgataatatatcatgaccaatgggtttatcttaggaatgcaaagttggtttaacatctgaaaatcaatgaacatagctcactgtattaatgacaataaaagagaaacctcataagataattgcaatagctgcacaaaaggcattttataataatcagcgttttatgataaaatctttcaacatcctaagaatagaagggaacttcctcacttattaaggtcatttatgaaaaaaaaattacacctaagttatattcaatgatgaaaagttcaatgctttctgcctaacattgggaacaatgaaaagatgtgttctaatgctgattttatttagcattgtaataaaggtcctggttagtgcagtaaagccaaaaaataaataaaaggtacacagatttgaaaggaaggagtagacctgtccttatttgcataacatgattgtgtatgttaaaaccctaagaagtatattttttaagtgaactagaacaaaaaagtgcattgagtaaagttgcaggacacaaaatcaatagacaaaattaactttataattacaaactaacaaataatgaaattaaacagtaataccatttacaatgaaaaaatattgggaaattttgggattaaattattaaaaagaaattcaacatctgtacatgaaaactactaaaattccaaaatgaagctaagaacgatctaaacaattagagatatgtactatgttcatggattggaataagcaatattttttaaatggctgttctccttagattgaattatagattcaatgtaataccaatcctagtcccaaatacttgtttgatgaaatcaacaagataattaaaaaatttatattgaaatacaaaggacctaaactatccaacacaattttgaaaaagtaaaacaaagtttgaggtcttatactacttgatttcaagacttactctaaagttacagtaatcaacacagtgtggcattggcataagaatagacacagatcaatggaatgggatagaaagtccagaaaaagaaatctacacatacattttcaattcatttttgacaaaaaaaaatgctgaagtaattcagtgggaaaaagacaatcttttcaacaacgtactggaataacaaacgagttatgtatctgaaaagaaaggaacgttgctgcttgttacatatactgtctaaaagataactaaaatttgatcgtagaccctaaatgaaagagctaaaattattagaattctaaaagaaaacatgagataaaatctttgtgacattgaggtaggcaaaaatttctcaggacactaaaaatatgaatcataaaagaaaaatacaaaaaatagatttcattcactttagattttttttttttattattatactttaagttctggggtacatgtgcagaatgtgcagttttgttacataggtatacacatgccatggtggtttgctgcacccatcaacccatcacctacattaggtatttttcctaatgctatccctcccctagtcccccatcccctgacaggccccagtgtttaaaaaattaattgggaaaagaataaggaaagccacaccctggtaaagaattttaaaaaatacatctcagacaaagactcatatccagaatgcttaaaggactcagtaataaattgtaaaaaaaaaaaaattaaaagtggacaaaatttttcaagatagtttgcaaaaaacctgcaaatcacccataatcacatgagaagatgttcattattactatgtatcatcaaaatgcaaattaaaacctcagtgagataccactacacacctgctagagtggctaatgtttaatagactgattttgccaactgatagtgaagaaatgatgtgcatgtgactcttatacaattgatggtggaaatgcaaaatggtatagctactttggaaaatagtttggcagtttcccataaagttaagtgcaaacataccatatgacccaacaatataatagctacaacctggcagcaatctaaattgtcactaatgcatgaatttgaatgcataaaaattgaggtctgtcagtcctatagattactcctttgtagtataagggaatgaaacattaatacatggaataacatggataaatctcaagatcattatggtaagtgaaaggagagaaacacaaaagactatgtaatgtgtgattctatttgtaagaaattctaggagaggcaaaactacataatgacaaaacagagcacttgttacctgggtctattgatggaatagatgatccacagtaaaggggcatagaggtctttcacatcccttgttagattcatttctagataggttatgttttgtgttatttttgtcaatggaaaaatataaaaactcatggaaagatgctaagaaaaatacctaaataaatggaaaggcagaccaagtacgcagaaggaagactcagggttgtaaaggtgtccagtttcctccaaatggaactttcaattgaatgaaatctcaatcagtttcccaggagaattctttactaatttaacaggctgaatgtaatgcatataaggctgaatctgacacatataataaacagcaaaatcctaaggaacaccaaacccttcgtgaaggaaactcataagggaaaatttccagatagcaagatgtactacaaaggtacataatttcacagtgtagtatcaatgcaggaatgagtcaactcatcaggggacacataaaaaaagtcccatgtgacccaatgactgcagatattcttgctgaaatattattgatcacatcacatcttatagagcgaataatgaccttctcaaattgtactgcaacaaatagttgcagatataaacatacaaaattagattcctacctcacaccatacattcatgtcatttcccagtgaattaaggctttattttttaaaggaaaattcaaaagtgtttcagaaaatatataggagaacattactatgaccatgtaatgggaaaatatttattatatatgtcatatcaaacacaaagggtaaacatttttactatattaataatttctgcttatcaaaatattttatatataaaacgaaaaccacaactaagaaaatgcactttcaacacataaaactaatgaatatttcatatgggatgtacaaaaaatctcttacaaatcaattagataaaaacattccaacagaaaaaagtgggcaaaataaataaaccaatgaattttataaaataagacaagaatagtaaataagcacatgaagagacttttaaactgattaacactctgatgatgcaaaataaaatcagagataccatttttacacccactgtattggaagatagtaagaagtttgaaaatagcaagttttagagaggatgtgagttatgagatctcattcactattggtgcctgttaaagtgtcataaccacttttgaaaataacttgtaaggttaagattcccataacccaggcaaaaccccgtctctactaaaaatacaaaaattagatcagcgtggtggtgcaagcttgtaatcccagctactgggaaggctgaggcaagagaatcacttgaacccagcaggcagaggttgcagtgagccgagatcatgccattacactccagcctgggcaacaagagtgaaactccgtcaaaaaaataaaaaaagaaaggaaggaaagaaggaaggaagaaagaaagaaaaagaaaaggaaaggagagaggaggggaggggagaggagaggagaggagagggaagaggagaggaagcaaaagtcttgtacatttttaccaaaagatgtaaagaagaatattcatggtagaatggtttgtaataacaataaaactaggaatgactggtatccattgtaatatacactagaatcgtgtacatcagtgagaactaagagccaagacagcatggactattatattcacctcagaaatatgatataatataaattactgaggaacacagtaaatatcaccttattaaggtcaaatgcaaaaaaaaactaaacaacatagtatttaaagatacataaatatgtgataaaactgttaaaagtaccggaatgataaaattcaggaggaaaaaaaagtaatcatacgttctaattctgaaatggtctcattggtttccgtagaaacaagcaggttttatgtacctcaaatgtagtacggcataatcttttttatgtatttatttattttattaagttccgggatacatgtgcaggatgtgcaggtttgtagcataggtaaatgtgtaccatggtggtttgctgcacctatcaacccatcacctaggtattaagccctgcatgcattagctatttatcctgatgctctccctcctcctgacccctgcaacaggccccagtgtatgtcgttcccctctctgtgttttcattgttcagctccccactgcatactcttaaacaatcattatgtttcatggtgatcagtaatgtgggggcggggtagaagcagagaacttggaactcgtgagggggtgtcaaaggtagtaaatcttcatccattgaaggcaaacttgatatttagaaattcattcagagtaaaagctaatggacgaagggagataaggtgacaatcaaattaagtagtaaccttttttgcaacttatataactaacaaacttaagtgctttctaaaaaaaaattctaaaatttgctatataagggcaacttcactgaaatgattgcagagtcttccatgtgagttcttttaatgtgagatagctcattcaatagatgcaccttggtgtgtttgcttaagaaacagaaaaatatgactcatttgatttgttcatgaaagtattaccaggaaaataaatgaaaacaatttcacctaaacatctgttaactttagcactgaagctttggatgtaatttacataatgcataaagtagattgatctaggaccatgtcgatgatgaaattttcattatattgatagactttcattttcctcataaaatctacacatacttaaattataacaactctgcttttgaattaatccagtctgcataatgtttttcagtcatcaactattatagtgtgaaatgcctttaccatcaaactggctcaaggttactgccttcactcagaaagatagtgttttccttctccccactgtgggccctgcctctcaacctgcaaccctacatttcagaaagtagtttgcctgtatgaaattttcttactctcttctaaggtagtggctgcaaaatggtacctatctctgattttaatttgcatcatcagagtgttaatgactttaagagtctactcatgtgcttacttactatttttgttttataaaatttcttggtgtacgcatgttctcactcataggtgggaattgaacaatgagaacacttggacacaggaaggggaacatcacacaccagggcctgttgtacggtggggggcagggggagggatagcattaggagaaatacctaatgtaaatgatgagttaatgggtgcagcacaccaacatggcacatgtatacatatgtaacaaacctgcatgttgtgcacatgtaccctagaacttaaagtataatacaaaaaagaaaaaaaaaaggcataaaaattctagaagaaaacattggaaagtgtctttatcatcttggagggtcaaagatctttctaattatggttcaaaactaagatgtcgttaaagatggatacatttgatgaaataaacatttttttaaattaaaaaaaattattggtgtatttattttgcctatttttttctgttggagtgtttttatctcattgattttggggagttgttttttatacaaccctacctttcagaaatacaccctttcattcataggagatatatatgtacatgtccatatgcataccattttgagtaagcgtttttactaattttctaaggggatgcttgaaatcttggttgttcatctacaagaggccagactcagcatctatgagatgtatagattcaaaggtattcatggcagcgaagagctaattcctccaagcaagagcacctaggggagctcgtggagcagatgaaagcatgttttgcaggatgtggctatgggccacaagcattctgcatacagatttactccaaagttggatataggaaattagtccctttactaacagttgtctttggctccttggagtatctgctttcttaatctgctctttgtgtcctgcccaagaacattctagctgttccaaaggttttcggtgtgtgcgcctgtgctttctatgtcaatgtgtaaagtaggagagaagcatcatgtgaggctggattaagaagagctgggcatattgcaccatattgaaagggccgtttgatgagtgggagcctatctttttttcagaactagtgattttactttacataagcattcgtcaaaagttgaggagagttccttgatgtttcatgtggtttttttctacttcctctcttacagatacagaattcatctacagagaacagaaaggaacagtgagactgtggaatgttgaaacaaatacttctactgtcttaatagaaggcaaaaaaattgtaagtactctctttaatgaccgggataatttcagtttttcttcctgcaagtcaataaaacagaaaatgacttttggtttcaacttttagcatagccaaggagaagcaataaacttgtaatactacaggctgagcaaccaaagataatgtgaaattgaaaccacgctaattcaataagatgaaagcactgtttctttcattgtctgggaaatttctctgcaggtgttgggaacaagtgttgcatatcatatataattaaaagataaagtcctaaggcttttacacatttacagaacaattgcaataatgcatgtagaatacttcaggagaatttgctcaatcctgtttaaaaaaagctcgtctccgcatgcataggaagtattaacttaggcactgtgactgtacttaccctaattatattaagtggatgcttatgcctcaaagtaaatactgagtcaatatgaatgccactgctttatgatttgggaaaacttgttttcccaaatatatgtatattttttgagacaggatctcactctgttgcccaggctggagcgaagtggtgcaatcatggctcatttgcagccttgacctcccaagctcaggcaatcctcccacctcagcctcctgagtagctgggactacaggcgtgtgccgccgtgcccagctaattgtttttgtttttgtttgtagagatagggtctcactatgttgcccaggctggtcttgaactcctgtactcaagcaatcctcctgctttggcctcccaaagtgccgggattacaggcctgagccactgtactcgaccccaaagatttaaatggcattaagatttgatgttcatgtacggttaaagatatgtattagaaatattgactggagttatacaccaaaatcaatttaaagagaattaacattttgtttgtttacaaaatgttcagactcttattagaataaataaatctccaactcaaagcagttgattcttttcttgtttgagacactggggaaatcaaaggacagaactaaggttaaagctatgttaaaaagcaagaattgaaacaggctgtgaatcccgttaaagcgatcataacagggctctggtatgaatcagaaacacagaaatcctagaatcctataatccgggattagaggaggttgtaaaaaaaattaaccggttccctggttttacagataaggatcctgagcgagacttagagcatgagcttttgagtctcacagctcagtgatggctgagggagcattcaggtggtgtcccagaagcctgtgtcccagggagaaggaaggatggcttcatctttaccctaccccatccccagatccacagaaatgctgtgctgccttcttttccctcctaaagaacatgtaacttgctatttaaatactttcatttcttttcttttgcataaagatacctttttattaaaaggtttgctgagatttagtattaaatgcatgctgcccctaacatagactgcaggcgtaagggaggcctcacgctgttggatgatggcatagttccaaaaatgatcactttattgaattaaatagtattctgcaaagtaggacctaggacaaatgaatgtgcctgcatttttgcattaaaaaaatcatctttggtagaattactcccctaagagaatctgattcaactcacttagaaatactaacgttgtagaaatggttttctaatattaatagagaggataaaatgatcagactgttgctgagcgtcagtgcattttaatgtcggaatgttatcattatttcctgtgaggatgtcagtttagtaaaggctgggtgttgtacataacagcagcacttagcaatgaaatacatgaatgtgaaccgccttctctttctaaaatcaatagcttgtgacagatcatatattttaactgaagttattttagccaagtcgcctttaataaggtgacttcagaaaccaccatgggtaaagaaaagttctcatctcagaaattcgctggcttattctatataatgcaatcttttttccttaaaatgtcacttttccatccattttataaacatttattaagcaccaaatatgtacagcctaatggattcattattcctttctcaaagctacatttaaatgctcctgtcaacagactcaaaataaagaagacaaaaaatgtcatttagaggtctgcatcctaatttaatttaatctggatttaatttccgcagagccacttagtcatttaaaattatcatgcctcaattgctctatctccaaattaaagctgatttcttctgccagcccagaacctgggtactctgtgagatccagcaatggaatatgtgtatgctctgtgtgttttcatgagcaagtatggagaaggtgaagcctggtgttccacaggggctggaggttggaggatcacccacagcctggaggaattgggaatggggagcagtagctcttccatattctgttctcttgccttcctggtgactgatcaggtgttctcttctcatttgaattccagaagctgtgagcttgtataaatgataaaaagcaatctgaggccaactgtaatttttaagttgggctataaaacagccttaaacaagttgagaaatggaaaggaattggtaaattctgtggtcagcagaattttaaaatattccctacaaccttgacctctaataacctcattctctttcccgagccaataaaaacagaccctcctcatagctggtcactgcaaggtaccaaagcctgtttgcctccagcttcttctttgctcctgcgcttactgtgattggctcttacatgggacaggtggatggaagggcctgcaaatcactgcaaacattttgtcaatccagcaggaaagcttttaagatagctggtgattaagcaaattcagagcttgtgctaagttctgtatttacatggatgtatttcacctttccttcccccaaacaatttcttttgactaaatttactaattcagtcatcctttattgtgcttttaaatggtagaaatcatgaaatatttcacaataccacaaacactttagattgttgagttcagaccaggtgcggtggttcatgcctgtaattccagcactttgagaggccaaggcgggtggatcacttgaagtcaggagttcgagaccagcatggccaatgtggtgaaaccccatctctactaaaaattaaaaagttagccgagcatggtggagcatgcctgtaatcccacctacttgggaagccgaggcaagagaaacgcttgaacctgagagttggaggttgcagtgagtcgacatcgttccactacacgccagcctgggcaacagagtgagactccatctcaaaaaaaaaaaaaaaaaaaagagtttctgtatgtgtaaacatttaaaattctatgatgattatattatggttcacaatttggggggcattcttttgttttatatatatatataaaacaaatatatatacacacaaatatatgtattttatatatatattttatatatatatatatagtgggctatttcctgatccttattatttgatagcatatcatatttgatggtagctaagaactgctttttagaaaacatttatcaaaatgtcttgatccatttcctcttttgagaatttttgaagtgcttgtctacatttctacagaaaatgaatcaaataaaagcacagttgtccccaaagcacaagtgcatcatctctgaagtagctctcctcagctgtaaaggctgctgcccagttctaagctcactggagcaggttctgtttgggatttaattttgtctcccacatagtgctcagcaccatgacctgcacatagtagatgctccactgctatgtgttttatgaatgaccgctctagaataacaaaacaatagagttgagcagttttccagaaacatccatgtgagtgacaggtgtggaggggcattcagcactggggtcatgactttgagcttcaggtctaccttccagccttggcattgtgctctgctcaggaacaacaggaccccagccggttgtgcaagttctgaatgtccagtcttatccctcaggagtgtcgtaggactgaattacagttgtaacagctggaatgtgggtatatgccacatgtggattccagagcgttaggctagaccaaagagcctgggccaggctcagggctcaggcaggaggagtgggttggttctatgaaggaagagacagaggatgatgatgtccaaaggagcatgacaaggatgctgccgcatgtgggcggctgcgtgggtccaggcagcagtagcagacagtggaatccacgccactttagttttgaggtccatccctcatgaagctggatgtagcctgcatcccagagtgaggcagaggcatccagagctggtaattacagcaagaggcactcgcagaactctaaacatcaataaaaaatcaaacctaagctcacttttatttgaattacatgtttgatgtcacagaaattccgggaccttacactttactcttttaaacacaattttaaatgtcaatgttattttacgtttcatgctccttataagactcttgtcaacaagatagcacatcttatcaaatggcctttgttctattatgtatcttgtttttttttcctaaaaaatgaaccaccacaaatatatctcatggtccaaaattggatctttggacatttggccaatggttgcctggttcctaaagtcctcatgaatttttatcttctgagtagaacactcctttttcctttccctccctccctccttttcttcatccttcactcctccctccctccctcccttccttccttccttccttccttccatccttccttccttccttccttccttccttgtagaaatacacttaaaatagccttaatacattttgctgaactaaatagatttcttggggacttaattcttacaaaaatttaacaccatctctccaattcttttaaaacataatagagcaaaaattatcagaagggtgaagtgtttcaccagtgcttaatatttagatatttaaagctgaaatagtctttagagactgtgtctttcaaactcttcttttatgaggtgaggaaactaagaatttctaagaacagttctctggcttaacctccactgatagtgctatggatgtaacgcaccagttcagaatgagtcactgtattgacctgtgtcactcatactgtataggccctttttattgacaatgctatcagtgacaagaagcattaagatttatatagtcattcattgtatcacttaaattctgccaggtgtttggaaagcaacttagtgatacgtttcaggagcagtaacaatattgatgcatttttatttgctctggggaatgcttctgtacaaagttgcagcattatttgttaatacaatagtgaaaatacttgaaactaggaaaatgagataactttttaaaaaaagataaaatatgatgtattcattaaaataatagctatgaagggtatgtagcgatacaaaaaatatttatgatatattttaaaaagatacaatatactaggctaacaactatatatattgaaaggctagaaagtgaacactgaactatgaaaatacttaatcttgttgggtggtgagattttgtgtattattttctagtgtggtgatttccataactgccatttcaatgccatttattcaataattttaatcgggatttaaaaattttggtttcatctttcaaaaaacagcagactgccttctcacaatgagtatgtaagagctgtagacagttcccggaaattcttgaaggagaaaataagtcgattatttaaaaaaaaaaaaaaaagtattctattgttatgcttatgtcaggctttctccatttttatgtcttgttttaattactaatttctttgttttaattgcttattttaatgactaaattaacatctaaatgaaatgtattttctctaagctgtatccttcttggttttatataatcatagatgtagaatttgaatttttatctctgtctctaaaaattaattaattctgactcctcacagaaagagacataaataggcaagtattattagacccattccaaaataagaagaacaaataataggcctgtttgtactaccagaggaactccagaatgtggctgagattagaactcgagactactttctttttacttcttcaaataaactccactggatacttgacccctgcatcagtaattctcactttattctatgtcatttaatttctgttaagtgctttatgcgctagtcctctcagccctgaaacagggtaaatttggaaggaaacagaagcccactttcttacctctttctcttttctgttctgcacagagcccagtgcactgttgaatgggaagcacaggatgttctgacaggtgtcatctcagccaggaacaggctggcccccgggaagtgggctcagcctcggtttcagctcctgttgtcctgagttcactgaccactgataaccaggacggtggctgcaacttcagtgggccagcaatggcccatgagccatctctaatctgaggctggatttcacttagcatgtcagtgaaaaccatgaggggaaacagccgtgtttttgtgtacggttgagagggcataaactggcagctcgtgatgcccactgaaatgttttgtttggcccacagagtggtttttacaaactaacccagatttctggcgtctcttgaaaaatacaaagatctggcagcagcaagatcctcatttgctcacagagagcaaaatttggctggagctaagaggcagctggcccctcagacaggacatgggccgaccagccctgcagtgacccacatttgctgacttctaaccagactggtctctgagtttgaaaccccttttagttcaggaacaaaagggtggcataagaactcaatgtcttctgcaagaacgttgcacattgtgagaaatcgtagcacaaactgtcttggtattatctgtattcatttctgtctgtaaaattccctggatcctctttgtccccctatgtcattatttcatttttctcctgtgtctcagagggtctctctctctctttttttttcttttgtctttcttgtcctacttttctctctcctgccttttctgtttctacttctcttactacaagatagaacagaaaacaagtatattttacttacttttattctaacttttaccacatagaccatgattttactttttaaagtggatgaggctgagcacagtggctcacgcgtgtaatcccagcactttgggaggccgaggcgggcagatcacttgaggtcaggagttcaagaccagcctggccaacatggtgaaaccccatctctactaaaaataaaaaaattagtgtggcgtggtggcaggcgcctgtaatcccagctactcaggaggctgaggcaggagaattgcgtgaaccggggaggtggaggctgcagtgagcagagaacacgccactgtactccagcctgggcaacagagagaaactccatctcaaagtaaaataaaaataataaataagtacagtagatgagtatttatacttatgtctttaaaatatctgaaaagaggccgggcgcagtggctcacgcctgtaatcccagcactttgggaggctgaggtgggcggatcacaaggtttaggagcttgaaaccagcctggccaatatggtgacaccccatctctatgcctgtagtcccagctactcgggaggctgaggcagacgaatcgcttgaacccaggaggcagagggtacagtgagccgagatggtgccattgcactccagcctgggtgacagcgagactccatctcaaaaaaaaaaaaaaaaaaattctgaaaagcagtacagtagtggtttaatctttctggccccagagctactgttccctgcaggctaagggctgtgtaccatcactcctccatcacacgtatactcttcaagtgacagtcagggaaggccttctctgtgcaaggccctgactagacatggtggtgggtggatacagtgattaataaaaacagatttctactcttatgtagctttcagcctgcatataaaagaagtagttgttttaacataatatattttgcaacggaggtattaatccaatgtgcaatgagaacaaggtgagaaagaaagaggattgctgggaactctagatagaggcttgcagaaggaacatttcagcagtccttgaacatgggagaaaagtcggaaatggcataataggcaaaatgaaaagggtggataattccacatttcaggggtagacagtgcggttagtaggttgttttgggaggggcttgaaaagttgtggctggaaggtctggggaaaaggtggagagaggtcttcaggaagcttccattgtgtgtagtctttagtctgtagcacatggaaaggtgtcaaccaaaattaaagctactgaagcagaaatgatgtaataaaggtttattggaagccacaggtgagaatcgatctgggaaaacacaccaacaaagttggacatgttccagaatctgttacaagccagaaggctttcataagaaagtttaggagaagtgaaggggactcctcatatcagagttgtcctttatcattaagaggtacaataaaaaggttccaatcactgacaacagattgcaacacacaggctaaaatgcctacgtgcaagacaatcagtaaaacttcatgattcagaggcaaatcagcatccttttcaatgtcagtagatcacacagtaatcagtacgtcaacaatttgaagagctcacagtaagattgtttacttagcgacaagatgacacacaagacttcttccccaggtgacttaatttggaagtttgccaaatgtgacctgtagggtattatttccctcttttgattaaaaaaacaacaacaactaaccatggaagcattgatgatcagtctctgcttacgttagaagggtagacatccttctttccttccttggctctgcgaaggctcattcccaagaagtcatgtccctgagtggggagaacaaaccttatcatcgcatgtgggccaggttgctagcaacatggggtagatcatgacacgaggttacatgccaatctcctgaataatgaatcaacctccagtctctggacgatcattattttggccttaactgtggaggcatagtttacaaattctggagaattcaggtacagagaaaggtaaatgttttaattttattcacaaaagtatactttacctgattgttttaaaatacaaatagctcctttatttataatttttagaaatatgttttgctatagtattgttattttatttggaaataaagaatgagtattatttaaattgaacataactttaagattgaaaattatgtaacaattatttataaaagtttatcccatttatatttacctaatttatttatttttaacagtttacctggattgctcatgaaaactgagatattggacaaagttagtcattatttcaagttacttccttgttaaccatttttatggcctgtgaatatcagatgttcacttaaggaaggagtttaggttaaatatatgggtattttgctaataactcagaagatacagctttttttcatttaaccaacaagattaaattagtcttacccttcaaaaaattacacaaaaatcattctggttttggctgggcttgtagttctataacctttgtgccaaaccctgacatttaaaaatatctagcagagacaaatataaaattgtcttccaagtataatgaggcaaaagggtatgctgacaatcttgaagacatttctacttttattttatcaataatttaaaaaccagcttgtttattaagggtttacttaagtcatgtgaacttgggaaatatttgtgtttactaatttatgaatgctcatttatttatgttgatttggtaccaggtagacataacatataatacatctaagtaagtgtaaacacatctaaacatacacaaacacaaataaagattgtacagctttcattttagaattttagttctttttttttttttttttttgagacgaagttttgctcttgttgcccaagctggagtgcaatggcgcgatctcggctcactgcaacctccgtctcccaggttcaagcgattcactggcctcagcctcctaaatagctgggattacaggcgagtgccaccatgcccggctaattttttgtatttttagtagagacagggtttcaccatacaaactcaccaatttataaaagacagctggatccaagttatatttctgacaaaattgggacctattcatatggctaaactttttttgcccctatgggtaatctaatgaaagctacagaccaaaagtttgggtaaagcagtttccatgtaagtttgatttttacaaacttcttttaccattttttataagtttcaaatgagttcaattttcaatgtttacattttacctgaaaactgaccaaattgcataacaaagacaaaatctccaagtagtcttgaaatagtaacaaatctatcttttgtttgctgatcttgtttgattagcaaatgcaggtggggaaaaatttttagcagtttctctcttttttgggggaggtggcactttttcctttcagcctttgtagcagaaaaagcaaaatttttgtgctagacacagatagatgattgctctgagctcaagattctgacttattagacctgagggcctaacttttctaaacatttatctttttcttttagattattaattgttcaattaagcatttcattttaatacgagtggctgaatctattttaccaatgccagtggaagatcgggatcataaatggtctggcaaagcttacaataaatcaattggtatcattcattagtttcagtttagaaaaaaacttgttggatctgtatttttatcatctcagtaatttcattctcatgctgtagtcctttcatttgctccttttgttccaaattcatacatttccctcttttgagagagaaggaaatgtgtgcattgtgaaattccaaaaatctctgcctaagaaatgtatgggagctgagggaacaagcagagaaggatgaggaatgaggagcagttggaggtgaaagggacaaagtctctgaagtctttttcacggcagagatagttgcgaatatccttttgtttacctcttgaatggaggcaattttttctttcaaaattttttatggaagcttctaggtgctattggaagtaagtcttccattcaatttgtctaattctaaatccagctttttccaattgtgtgcccaagtaaatcattttaggcatttcaaagggtccccattttgggtgttgctgcttatgaccatgccaagttaggtggatccacttatctaagcacttgcaggtaaaaggaccaaaagtattgtgcataaaaccagctggtgttgattagaggcagtgcactgtcagtctcagaagacctgctttccatcgtgattgttttgagtgagaccagctatgtagtggagcaaaagtgcccctcatgccatcactaaggaaaagtgctttcgccccaaacctccagggaaaaattcacagagctactttaccttgccctaaaattcaaacaaaaacccttaccttggattggtaagagggatactcgttctgagaaagacattgtattttctagccaaggagaaagccagcttcaaaaaaatcacaactttgaccaagacgggaagtttgttgatttcaggaagaactcatctgtaccacccagcaggggcgtccaagctcacaatgggtttgttgccaggatctgcatgaaggctggaagctgtgctggatggtccatggaggtcactccaaagcctactggctacaccataatgttgacagaaattaaggctgaaataacgtgataaaaggtgtattggaagccaaatgtgaggatcagcccaggaagacacatcaacaaagtcaggagtgttctagagtctttaacaagttggaaggcttttataagaaagcttaagagaagggaggggactcctcatatctgagttgtccttttcattggagggtatgatacagggcttataatcattggctacggattgcaacatacaggctgaaatgtctgtatgcaagaaaattagtaaaacttcttgattcagaaacagatcagcattttttcaatgtcagtaagtcatacaaataatcagccacatcaacaatttgaggaactcaaggtaagatactttactcagggacaagatgtcaccatgcatcacaagaccttcccccaggtgggttagaatttttgagctggttagaatttaaagccaccgtgctttaggaaaataactgtaaccaataagaaaggggtttgtagaaggtaaagattataaacaaaacatcgacagtggctgcttcaagtccaggtgaatgtgatggaggtcttaaattaaggcagtggctttgaagacacaggagaagttggtttaagttacatcacaggagtagaattgataacacttggcttcactttgtgtacaggcagatgggattaaacaatagtctatgttgtctggggtttttcgagacttgctcatgggtggagagatgtcaaattcagaaactgaaatggggagagaaacagattgtgaagtagaaaaccaaagccactttgaggaataagctactgcaaggtatatgcagagttcattaactaatagttgatattttgagtgcttacggtgtgactaaagaatcctaaacactctacgttcattatcttacttaaccaaaatccttaggaactctgtgagcttcagtactttattattattttaaaactcagaaaaaagaggttaaaaaaccttttactaagtcacacagctgatagctgatagtcctgagagctgaagtcagctttgtctagttccaaactaaattatttctagactgcatacataatccagctgtagccttggtcgctgcagttataagatagggctgaggccgccattccattactgagaaggaagccaccgcttcaaacactgtgttcatatctgtgagtccatcattacatatcacgtggttactcctggaggccactacatttgccctaaaatgaagactagagatgcaaaacattgagtcagtttagcctaatgccaaaaaaaaaaaaaaaaaaaaaagtgctgacacagctgagtcctggggaacgatctgtttcaaggttagagagaaccgagctgtaaaccatctggacgctttttcgatgtggctatttaatcatctttccactctgctctatagcatctatgttttcaggttttctctgactcagtaaatgcagtgctgggagcagcacccgagtctgtctgattcaaaattaaattattcttaggtgaattcagggcccagaggcaggctgtggccactatcattaacattatcgccaggcccaagggttctgtctttctcattgaccaggaagggagaatacaatcatctatttatgttaaatttgatgtgtgcacccacagagttgcacatagcatcctcctgtaacaatcttttcagtatttgtcttttgttgatcattactcatcttgtatatttagggttttttttcattatgagtttcatgaggaggttgtattcaaaaaagcctctgggtatatttatgctttctaccattcatttcccttccattacttgacaaattgggggcattctatcattttatatctcttttttccctaacaaccaccttttcttctctgcatttattatcacatatgtatttatctactacaggaaaaacaaaccaatcctttagttagatatgtatctcctcagaaacatgcctagaattttatataaatgggatcatcatacatgtagaccaatatttttaaagtcagcataatgttatttaaacttgtgttattgatataactggtagccccagataatgcaaaaggtgaaatactgtatatacccatctctctagtaagtataaaagttatgagcaaaatattaacaagtggagttcagctgtgtaccaaaatcataatatgctaaagtcaggtttaatgattacaacagcatttaaatatcaggaaatcaatcaacaaaatttattagaactacaaaatgatagaaaaatccttatgattaagtcactaggtgctgaaaaagggatctgataaagtttatcaacagctcctaataaaaatccttgctaatgtaagaataaataattgcttaaatatgctaaaggttgtttaccaagaaccaaccatcagtgaaaaccattctaaatgacaaacaataaaaccatttcaattatagccaggtatcaggcaagaatactcaccatcaccattaatatttaatatgttcttgaagaaagtgcaaccaaaccaaatgattcaaataagaactagaaaatagaagaaaaaaagacaacttttttctcataatagaattttatttctgaaaaacctaacatatattagttttaatatacaccatggaatactatgcagccataaaaaatgatgagttcatgtcctttgtagggacatggatgaagctggaaaccatcattcccagcaaactattgcaaggacaaaaaaccaaacaccacatgttctcactcataggtgggaattgaacaatgagaacacttggacacaggaaggggaacatcacacaccggcgactgttgtggggtgggggaaggggggacggatagcattaggagatatacctaatgctaaatgacgagttaatgggtgcagcacaccaacatggcacatgtatacatatgtaacaaacctgcatgttgcgcacatgtaccctaaaacttaaagtataataataataaaataaaatttaaaaaaatccaaatgtcaaaaaaaactaataagaacatatcttaatatggctaaatacaagaaatatattatgaaatcaatagcttttctcttcaccaatataaataccttgaagtgaaaatggagaaaatattccattcacaataagaacaaaaatataaaaagacttcaaataaatctgacatgaactccagaagattgaacaaagcaaactataagatcttgttagaaatttgaaaacattaaaaaaattgtataatattaaataagaaaacaatatttaaaatgttaattatttgaaagttgatatcaaactttaacacaatcctaattagaactctgaaactgctttagtgtaaacattttgcaaaatgatcttgattgtcatatataagaataaacacctttgtgtagccatgaagcatttcaaaatgcatagtaatgtatactcttttacctgcagtgaaaacacacaagaacgacgttatattcaactcaatgacaataatagctaacgctttgaatacttattatgtaccaggtattgtaattactttattaaatttgtgtatcaattatgaggtaggtacaaatattatctacactttacagaggcataaaaaattgagaaattttcagcatctctcatagtgaatggtataaacaggatatgaatcacagtctgtctgaatccacagtccaagcttaaaactatcaaattttgcatagaagtagcaaagagagtgctgaaaaactggagaatttgaaagaagcttccaatataaacaagtatttgacatgagaaacactagggatagggtgacacacttagaacacagtgctggcataactaactcttcatctacaaagatgtaatgtaagtctcattgtacaaatacacaaaattacgttccaattggattaaagccttaaatgtttttaaaagtctataatttggtttcataaaaagagagaaatttttaatcaaaataggaaatcctgaagctataaaagatagccatatttaatttgccatatatgattttaaattttaattttaagaaaggcaaaattagtagacaaacaatggaaaatatttacaatccaggtaacaagtaaaaggagtatatctacaactgataaggaattcttccaaattgagcacaaaaagacaaataaataatagaaaatgaacaaaaatattttagaattagctcaatcaagcctgaaaccaaggcctgctttgtttgggaaattgatacatagagcaaacgttcaggaatgtgttagatgtttttttgcattcactattggcacttggtgagaaggtagacctgcagctcaaaatttgtacaactgctacaggatcccttgaatttgtaacagggccactcgttctgagaaagacattgtattttctagccaaggagaaagccagcttcaaaaaatcacaacttcgaccaagacgggaagtttgttgatttcagggagaactcatctgtagcacccatcgggggcatccaagcttatccaccagataagtggagccacctaacctggcatggtcacaagcagccaagtccaaaatggagactggggtggtcagaaatgcctggaatcacacctaaccatggcagtggtgagtttctcaaagagaaaacaaattctcactgtctccggcagcatcgttagcaattgaccctccatcaaggaatgtgacccggactaatttctaagtgtaaaagttgcattctttgctggtttcttttggtgttattgcgtatcagccccactgttgccactcttgtaacagctgaggatgtaatcattcatttcttcagcaaacatctagggagcatctctattataacccagtcaccgttaggcactgggaatagaaccgtggcaaaacaaactaaaatttgcttcttggcatctggtcctggccatgagactataagaggattggaattaccctcctaacataaacaactataaaatgggataaaatgtggagagaaaaatcagttttcatgtattggacagcaggcagtgcacagctgtgatccccgagaaaagaaaaacaaatgaatgaaccatgccatcccgtgggctttctgcgtgaatgctgtactgcagcacgaaggggaaaaattcaagacctgcagtcttgccaagttaagaagacagaagtcagagttcaagaaaagaagatggctacagtttatgagatggagtacccaaaaggaggaaactagagaatactcacaaaatctatttaagtaattccttttaatggcaaaaccacaattactttattattattattatactttaagttctggggtacatgtgcagaatgtgtaggtttgttacgtaggtatacacgtgccacagtggtttgctgcacccatcaacccatcacctacattagggatttctcctaatgctatccctccctttacccctccacccccccacaggccccagtatatgatgttcccctccctgtgtccatgtgttctcaatgttgaactcccacttatgagtaagaacatgtggtgtttgaaaaaccgcagttacttttgcaccagcctaatacatagatttccctttgagacctcggttaattattgacctttatatgtgaataatgaaacaccaaaaggcagaacaaaataaaactccaaggaaataacaattacagaactctgttagatgaagtattcccagagctcatatattgtcaggaattatttaagtttattctaaccatgagacattaaacagagaccccaggaaagtagtttcttaggatgaggttcaattagcactcaaatatagtcatgtgtcacataatggcatcttagtcaacaatggatgtaggacattggtcccctaagattataatatcatatttttattgtatcttttttatgtttagatatttttagatatacaaaaattaccgctgtgttacaactctctacagttttcagtagagtaacatgctgtacaggcttggagccttggagcaataggctatgccatatggcctaggtgtggagtaggctgtaccatctaggttcgtgtaggtactttctgtgatgtttgcacaatggcagaatcgcccaatggtacatttctcagaacatatcagatatattgttaagtgatgcatgactaatggccactatggaataacccttaaaacatcttttttaaaaaccttgaataagtcaggttaatccacaaataattaattgcctgtcataaaaagtccaatattctttgaaggaaaacaaaaagtcctaaattcaacaagagagaattaaaaatatctggtgttaatttaaaaataaaacatgatatatgcaaaggagcagggaaatgtgactcctaatgaggagaaatatcagttgatagaaacagaactcctgataacaaagataagggaattagcagaaaaacacatgaaaactgctaagataaatgtattccaaatgctcaaggctataaggaaaaccatgaacatgatgataagagaaattaaagattataagacacccagataaaatttccagagattaaaaaaaaaaaaaattctctagatgatcaccaggttagataccacagaagaaaaaaaaaaaacccctaaattgtaagcagtagcaatagaaaactatttaaaaccaagaacaaagagaaacttgaaaaaaaaaaaagcctgaacagcatgtcaataagctgttggacagtataaagtagactaatatacctgtcattaaagttccagaaagtgaagagagaaaagaagataaaacaaacttttgaagaaataatgactgaatttcttccaaatttggtaaagaactcaataaactccataaagaaaataataacaaagaatatgataatcaagttacttaagatgagtgacaaatagaacatcttaatggcagccaaaggagcgagacgtgtttggaagaacaaacctaagaaaacagctgactcttcaacagaggtgctgcgagccagaggacattggaatgagatcatttaaagtgctgggaggcataaaacactgtcagtctacagttctacacaccacagaaatatctctcaaaaataaacattaagaatttgtataggcccagctactcaagaggctgaggcagaaggatcccttgagcctaggagtttatggctgcagtcagctatgatcacaccactgcaccccagcctgggcaacagaatgagacctttttctcttaaaaaaaataatatatatagatatatatataaagatatagatatatataagatatatataaagatatagacatatataaacatatatatataaagatatatattttcagagaaaatcagacagtatttattggccataaacctatactatgagaaacttaagggaagttctttggagtaagaaaaattacaccagatgaaaagttacatctacatgacagaaggaggtgtgccaggaatgataaatgttgtcaacatatggccaggttttgggtggaaatttttgtagaattagttaactagttctttaaaatatccttccttttctcaaagggtcctttaaatataataaaatatgtccagctcctctgaatgtaatctcatgtaagacttctgtctgaacctttgtcctgctctaaacactgacatggaaagtgaaaatataaacacataaaacctttggaacatgttagaactttcttggacaatagtggcaataataaatctgatctaatatagggtggactataactgacagtttaaaggacagatttcctatatcattatgcctacaagctccccttaatactcctggaggattttatattttgtttaaaaggaaagatccaattataagctatctatgttatctaattttaatataaagacatagattaaaattaagtgaattttaaagctgggcatggtggctcatgcctgtaatcccatcactttggaaggctgagactggcagattacctgaggtcagagttcgagaccaacctggccaacattgtgaaaccacatctctgctaaaaatataaaagttaaccaggtatgatggtgggcgcctgttatcccagcagctcgggaggctgaggcaggacaatcgcttgaacccaggatgcagaggttgccgtgaactgagatcatgccactgcactccagcctgggtgacagagtgagactccgtcttaaaaaaaaaaaaaaaaaatgaaatggattttaagagatataccatccaaaccctagtcaatgaaaatcttgaatggctatattaatattagataaaatagacaacaaggaatattaccagaaataagaagaaatatttcataatgataaaggagtaagtttattaagaagacttaagaatcctaaagatgtatgcagctagcattgagctacaatatttgaagcaataattggttgaaccaaaagaagaaatagacaaatccataatttaagttgtagatcccaacaatcctctctgagtaattgatagactatgtaaaaacatttaataaggatacggaagtcttgaaaacactattaaccaagtcaaccgaattgacatgtgtgcatcacatcactcatcaatagaaaaatgcacattcctctgagtgcacgtgaaacattcaccagagtagactatatgctgggccattaaacaagtctcaatatattgcaaaggatggaaattatacaaagtatgttctttaacagaaacaaactagaaatcaataccagaaaaaatatctggaatgtatcttgataattggaaattgaacaacatatttctaaataacaaatcagccaaagaagaaactgaatgtattttaagtgaatgaaaataaaagcaataatatcaaaatttacggtatgcaacaaagcaatacttaaaggggaatttatatctttaactgttcatattagatctcagctttcacttcaataaactaggaaaaaagatttaaaaccccaagtacacagaagaatagttaggagcagaaatcaactacacagaaaacagaaaaatgttagaaaaaatgaccagctgttttttggaaaagatcaataaaatcaatcaagagcaaagataatggaaaaaaaatcagacaccaagcaaacatattaataatttggacaatataaatgaaacagaaaagtccttgaaagacacaaagtattacagttcaccagttaagaaataagtaacctgaatacctggatattggtgtaataaattgaattcgtagtttaaaagccccacatattaaaactcaaggcccaaattgattcacttgatcaattctaccaaacatttatgtaagaaatagtaccaattctgcacaaacttattagacaaatagaagaggaggaagatatatttccaaaattcatttcttagggcagtattaccctgaaataaaaaccaaacaaagaagttaaaagaaaataaaaccacagatgacattccctcatgaacacagatgcaaaaatcctcaacaaaatattagcaaattgagtccaacaatatataaaaaggggtaatacatcacggtcgaatagcttatcccagcatgcaaggttggtttaacattagaaatcaaacaatgtaatttaccatattgacagattaagactaaaaaagcaaaataacataatcatctcaataaatgcagaaaaagcatttgagaaaattaaacatacattcattataaaaactctgagcaaactagaaatagacaggaatatcttcaacctgataaaagatatctattaaaaataccataaatatcatacttaatggagaagaatgaaggctttctcctcaagattagggaaaaaagcaaggctgttcactctcactacttctactcagcattatactagcagttctctagagtgcaataaggcaaccaaaagcaataaaaagtgtctagatagaaaagaaaggaaatacctatatacacaggaaatatgattttgtagaaaattctaagaaatatacagaaaatatctaccagaacaaataattacatgtatcaatgctacagaaaataaggtcaggatacccaaatgaattttgcatattagcaataatcaattaaatatttaaattaaaatatacatgtacttttatatgtacaaagcatcaattatagtacatccttgggaataaatttacaaaatatgggcaaaatctgtattctgaaaactgcaaaacattgctgagagaaattaaagattaaaaccatcttcctttcaaggtgtttacactctaatgaagaaagcaggcaatatttaagataaataggttaaaaaatataaaatatgtattaatatgattagacctagagaaacaaatcagagaaaggggtataaaaagtcggaggcaaggcagttaatatctagatatattagctattgaaggacatggaaggcctcacttagaaggtgacttgagataaaagccaaagaaatgaaaggttgagagcatttcaggcagaagaaagaggagttgcaaaggccttgagaatggcatgtgcctggcttgctttaggatggacagagactggcgtggctgcagtgaagcagatgggactgaggggagaatactgggagatggatgcagagagctaagagggaactaggtccagcagggctgcctggtcagtcaggactttggcttttcccacaggtgagatgggaagctgtgggagggtttcccaggggagcgatgtgatttacatatttgagagatggccctggccgcctgggaaagcaggtagaaggccactgcagtacctcaggaaagaatgcacataccttagacaagggtaatggtggtgggaaagagaagaaatggttccaaacctattttgaaggtaaaccaatggtattttctgaccacctagatgtagggtgtgtaaaacagagggaaagagaaaagatagccaagagtttgacctaacaaccaagctaatggggttgccactatctgagaagaggaaaaaggttacaggagctggaggtgtgggagtggagtagaagggtctcagcttattcccattgacttgaggtatccatttgacactcaagtacagatgtcagggaggcagttggccagacaagcctgaagttcaaggtcaggtccagtgcgggttcaggtggtctgggctggagacatgaatgttggaatcctcagccagactgcgcatggtttttagaaccatgagactggataacaccacctaggaagtgaggagatccaaatatcaatccttgagcactccaacattcagagctcaagaaaacaaggagaagcacaaaatagcatgaaaagaaccagcgagggaggtaggagaaaagcaggtgatgagtgtccgggaagccaggtacagtcagggcttcgaggagtagagagactggtcatctgtgtcaagtaagaggacagctgagaaattatgacatttagcaaagtgagtctctgataaccttgagaagagtaattgtggttgagtggtgggggtgagagcatgacaggcaggagtttaagaatgaataggaggagaaaaatggaagcatggagaatattttcaaggggaagtagacagacagttttctaaagataaaatcaacattgtctaaaacgtggatagtaaggatcaaatgtatccataagcagggaaacaaaaactaatgaggcatgtttacatctacaggagggtcaaaattggagaaaaaacaccttatgcttccagagaagggaagaaaacatgcattcatacatctgtagtgggagtgcacattccaaaaacatttttgaaaaagaatttggcaatacctatttaattttaaaatttgtaaactgttcacttcacccgtggatatctattctatacaaaaatgtgaaaaccacacatatatcaacaaagacatagattgggatcttcattacaacattgtttatagaaagagctcactagaaatgcttataatctatcctcattattcacagcttctatatttccaaattcaaccatgtgataaagtgtacctgtgagccccaaggtgataatcacagcacttttgccatcgttctcaggcatagtggcagaagattcgagttgtccaatgttggcattcccaactgcagcagaacaaagcactattctgctttctcatttcaactttcatgctgtgaacaactgtccttttctgttgttctatttggtgctccatttttttgcatgtttgtaacttacactggtgatctcactgttgaaagtgggtcccaggcatagtgctgaagtactgtatagtatcactaagggcaagaaggctgtgaacgccttatggagaaaatgcatctttgagataagctttgcttaggcacaactcatgggttgttggccatgagtccaatgtttatgaatcaacaatatatattcaataaggtgtccttaaaaagaaagacacataaaacaaggttatctattgatcatttgactaaaatgtttagactagaggttcaaaggaagctaacgttgagtctctcctagaagcaatggttcagtatccactagttgcacatgaactagtgttcatgatgactttatagaacaaagcaaccataaataacaggaatgaattgtctccctttgttgagaattgtgtgagtaaattaaagtatatcccaaggtgtgcaccatgtgatattacgagccctttaaagatcactactcaatcaaaggaacccaagtccttggagtcatttccttaaggtactgttgcatgagaaaactaaggtgcagaggaccataatatgatgtcactttttttttcttttggagatggagtgtcgctcttgtcgcccaggctggagtgcaatggcgcgatctcggtccgccacaacctctgccgtccaggttcaagtgattctcctgcctcagcctcctaagtagctgggattacaggcatgcaccaccatacccagctaattttgtaattttagtggagacggagtttctccatattggtcaggctggtctcgaactcctgacctcaggtgatccacccgcctcggcctcccaaagtgctgggattacaggcgtgagccactgcgcccagccaatgtgatgtcatttctaacctttgtcatctctctctgatttcatgtggttgcctgagcatgcatagagtgatgtccaccaagtcagcaatgtgggctctgggggtgggtgtgggtatctgtggagcaatgtgcttgcagtgcagagggcaggggcaattaaaagaaaacagcacagttgatggtatcatttatgtcggatgatgtttgtactatgaagaaatttgaaggaaaaagtcacagttagtcttctatgtactgacttgtagggatgaccatgttggaaaaagagcaagttgcaaaataatgtgtgcaatgtgattctattctagtaacaactctgcttattatatgtgtcttagaattagtgagaaaaaggtttctaaacatatcaagaggttgagagttttgtagaaaagtttgctttttaacgcttatttctttttcttttcttgctctctctatttttttttctgagatggaatttcactcttgttgcccaggctggagtgcaatggcccaatcttggctaactgcaacctctgcctcccaggttcaagtgattttcatgcctcagcctcccaagtatctgggtctacaggcatgcactaccacacctagctaattttgtattttttttcttttttagtagggatggggtttcaccatgttggccaggctggtcttgaactcctgacctcaggtgatccacccacctcggcctcccaaagtgctgggattacaggtgtgagccagtgcacccagcctttaatgcttatttatattggcttgtctcagtaagtccaataagtatgttttgttgaaatttgaaaaaaaatacaaataaaatatgaaaaaacatcaattagctaaatattattcagctaacaaagaaaggatatagccattttaatagctaattaattttgaaaatggcaccagcagatacaattttattataagattctgacttgttgtatgtaatgctttaaaattctttgtctattttttcttttaggaatcattaagagccatcagatatgaaatatctccagatagagagtatgcacttttttcatacaatgtggaacccgtgagtattatcctttactgcctacaaaataattgtttctttattctaatatctcattaagtatatttccttgactcttctatacttagtgatctttgaatccagaaatactttgtacatcctggaagtctcttttgcatatcatactgccacctaggagagaggaaaggtataaatatctgcttggcaggggaaaaaagtcacatactttagaggctctttcatagacttttcttaggaggatggtaagaacttgtctcttcatagacacaaatcttgcccttttgtgcaattatttttctggctgttttctcagtgaaataatagattttatcctaagaacaaaaagcaactgccaggttctccttaaactgaaataatatgttaattatctcctggtcattgtagtgttctagtgaagagctgaagctatcacttccactatttaaatgcctatttttagcacttcctgtatatatgagcctcccataaaatttcaccagaattttctgtaaaatctcactgtgtattagtagcagtgtaaaacttcctaggccaggatcttccttcttcttcttgttttttcatttgacatgctcgtatttcaaatttcattttggctctttaattttaaatagttggaaggtgaagtttatttgtataagtggagaggatgttcagtttacaagagataagcaactttagaaatgtatgttttaagaactttcctctctggcaaataagatatagagtctactactgcctccctggcatttctgagaccatttgaaatagagtttcctggtgcttctgtgaggtgtaatgactcctgcattttaattcaggtcagaatggctctgtggtgagtttgagagaatcttttctggcatgagacagtcaagctttttggtttatatccactgggaaagctggggtattggtttgtatgaagatgcaagttcaattctgaattcttaaactttcttttagaagttgattggacaactggattactggagatttcaactttattcttccaactgtagatttttttggactctgtttcagtcttccatttttctatttttaaatgtccattctataaaggttttcattttttccatccaaattctttgaaacaatggggcatctttgtctctttgattgggatcagttggtgaacttgacattctaaaaggcttgggactctgcattacctagacacagccttaaacttgcctctttcagcctcaggcacctggatgtgatgttcacgggtcatagaccatttcagcttccttcatcacccttgaaaaccaccagaaatacaatctccacacctgtataaaagaaaaatgttagcagatatttgaaagccttacatggatgtgttctggtttgccccaggaggcacagctaacacctgagtgagaaaagcctagaaagacaaattgatttcaggttatcctcctagagaatctttaatcatcggagcaccccgacagtgggatggaggtaatgagcattccgttcccagaagcctcaaaacaaagtgaggtattgttctccggaatgtgacagaggggttcccgcagccgtgtgatcggaagaggcgtgctctagtcagtggtgctgtggttctgtgcatgatacaattctccaccactttcttcggcttcccagcgctctgtttggaagagtgccctgggatcccattgaaccagaaaccattttgataaagatcattttgctaaagatgagtcttcaccatgtggagcactggctgtaaacaggaaccttgaaataaccctttctcactgggcagcatctgtcggtgtttggagtaagactcttcagtttgtcttctcaactgaaggaaaacctaggaagtttgaagtgtatttacagaactataaaaatgataaaattgaaaatgtaaaaagtctatagaaacagatattttaagttgaataaaataagtaatccttaatagttttcagcactgagcagttactgtatacatgactattcaagcaagtattctctgttcttctggaggaaaaattataagggaaattataacctataggttatgagtagtgtgtcttctctctgaactccttagcgctataccaagatacaatccaagttcttgaaattctatcaaatccacaaaatatgtaataaaaggattacatatgggattctgcatgagaatttggagttagatattaggaagatcttcctaactagataaactaaaatgtaagtaattttagaaaagggaggggtaaatttcaaaggaagagtctaggtctgtgattctggaataagtggaatagaccaggacttcctaatcagtatttagtatcagtaattgttattgctagtattgtattaatagtataatcaattaaaaatattatccattggtattctttaaaaacaattaaaggttccatattcaaatacatttgagaactctagttaaacagataagtttcttgaagttcctgatattctcatgttggttacatagtacttcccaagtgggtattacaacatgtgattccaatctaattataatgaaactagaatttgttatttggattcatgctcaacatattcttatgtgtgtatctcaaaggcagctagtgtaacttgtttatatgaaccaactcaacttttcattaaaaagactatcataaaattgttttagtgtaaaccaactgtccaattactagatatctgtcatttatttcagtatatgtttcatttgcaataaaattttggtatattgggttaccactgcactaaaaaaaaaaaaaaatcctactatcccacatttcgtcaggataattataatctcttcaatctctgcttctctttgttgcctgcccaaagatactggacttggaagtcaaataatcataggttcaagggctcattccgatgctcaccagctatgtttgcttgagtaacccactaaaccttatgcactgcatcttggagccatcttcctgggtgaccctgggcttctgtttctcagtggtgaagggcgacccaatgaatgtcagctctcctacacttccagggtatatgtgtttgagcacagagtagttccgtatgtatacccagggccagatttaaggctctatccaatttcattggaatggagttgatggatgcctacatgaaatcagctgtcttggcagtggctcaagtagaagtgagtaagagctttccagcacagcatgggtggtaagagaaatgaggaaacagatcattaaggagtttagacacaaatagtacagcaacatcctgagaataagagttgaaggaaagatgtttaagtttaatttttagaatatgcattgggtatctcttcttctcatttattcagactaattgcaatgttatatcatttcccagttgtttggcatagactaatttaatttgtccatttttatattgtcagatactcaaagacagggacaggtctttttatctcctatctgtccccacctcagaggacccagcacagggtgatctgcgtacatttagtactgagcaaatatatttgtggtgtgtgtatattctctccgaaccccttagcgctataccaagatacaatccaagttcttgaaattctatcaaatccacaaaatatgtaataaaaggaaaatacctcagttgtgaaatatcctaataacgttccatgtttattctagaaatgtgggatcatgctaattagcatgctttttcctactaaactcttctaatattactaaatgtatagcttggctagcatccttgaacatacacaagttagctcatcttaactatgccaaccctatgtttttttgagagctttaaaagtagcctttaaaaaggtgtttgaaatatcaattatcaagtaaatttgagaaacagcaaacccaattttccactttttcaagcctcagacacctataggttataagtagtgcatctggaatgttgaaaataataaacagtattgtgtttgtatttatgtggcaccagcattatagtttgcaatgtgtgcttatttacaccaccttattttatctcaaaagatcattcctgctccaaagagacaacatgtgctaaatgagttttattttattttatacataaaatttcataacatttctcagtgtacacttcctgaatattctcttgaaattaagttagacattggagaaatagcaattttttatttttaatttgaaaactgtattaactatactaataaagaaaaattgccttaaaacaaatgtatctaattagagcagccatgcttttttatattgagatatatttgacaaatatgaaacatttccaaatctctttggggagagggaaaaagaatgtaaaatgcattatctaagatcatttaaaaatattaatactttttcctactaaactattttaatattactaaatgtatagcttggctagcatccttgaacatacacaaattagctcatcttaactatgccaaccctatgtattattgagagcctaaaaagtagcctagtattaatatcttagatcatttaaaaatattaatttcaaagacctaagagaaaaatattcttccttgaagaatcatttctgaaagagtcactgaagatttgtgaggaatttcattgcaatatttaaaggagttagttgaaatgattgttcttagtcagatcattgccagtggaacatcattctggtccaaatgaaattctgtccaaaatctggtcagattttaagatttttttcctaaaatcccaatcacacagtcattcagtcagtaaaatgggttgatacactgatctgtttataaactgttcatataactgaaacacataaaccaatccgttttagttacttgccactgcatagcaaattatccccaaacatagcagcttaagacaaacaacatgtatcatcccagtttctgctggtcggaaatctgggctcaagttagcaggatccttgcactcagggtcttctataaagaagactgtggtcaaggtgacatccgggctgcagttgcatctgagagctcacctggggaggagtctgcttccaagctcagggcatgggtgttgacagggcccaaatgccatccttagagatgggttctgctcagtcctgagagaagatggtttgctgctgagcttttcatggcaggaattggaagcagttttcatatttgataaatttctactattttcctgccatcgtggtgagttgatagagcccattttgctctctaagggactgtgaaatttataattcatataaagcttgaagaacaccctgatgtggataatcctgatcaaacctgcttggtgaggtgaaccccaactatatcccagaatcttctatgcacccatctggtcgagttacctatttatctatatcttaattaattttaaaaaataacttgaggctttataaatgtaatataagggattgggctataaattattgaacccatattgtggactaaattataactgctggaaatcaattcaggtaattctgagtatatgagtttctttttttttcttttcttttttttttttttttttttttttttggtggtgtctcactctgttgcccaggctggagtgcagtggcgtgatctcgactcactgcaacctccccatcccaggttcaagagattctcctacctcagccttctgagtagctagcattacaggcacccgccaccacacatggctaattttttttttttttgagacagagtctcactctgtcacctaggctggagtgcagtggcacgatctcagctcactgcaacctccacctcccaggttcaagtgattcgcctccctcagcctcccaagtagctgggattatgggcacgcaccaccacacctggctaatttttgtatttttggtatagacagggtttcaccatgttggttaggctggtctcaaactccttacctcatttgatccacccgcctcggcctcccaaaatgctggggttacaggggtgagccaccacacctggccaattctgagtatatgagtttctttgttgcaagaaatatagctattgttataatatggttctgatgtttactgccatcccttcttcattacaagaagggatgaaatcttcgtccaggagtggctaagggaattgtgtttcttgattctcgtgctcttggactggttctttctgcactgtctacagagcctttcctgggcccacctctgggaaccagttgatccaagcgttttctgctggacgaaggccttgcacattctcatgtgtgggggctgctatcagaattgcagggagctctctgtctccctctgcagtggcctcagagggcaaactgaagagcagggcctgcgtgtgccatttctaccacacctgccgccctttctgcatcagcccagtagctgctgcagcagcaggaggcgagtctcaccttcagcacgttctccttctgagaaggcagtggatgaacagcctgtccaccacccactgagaccagaagctgccccttcactgcctggaagtgcatcctgcacccatcagcatcactccaagcccttttatcccgggatgaattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttttaagtagaaggagcgtaacagtggctaggcatcactccataatctagctctccacctgagcaacacgtgcagagcttcaagaggctctgaattctttctggctgccagagataaccaattatacaaagaagaaaaatctgccaggtgcagtggctcatgcctgtaatcccagcactttgggaggccaaggtgggcagatcacctgaggtcaggagttcgagaccagcctggccaacatggcgaaaccccatctctactaaaaatacaaaaattagccaggcatggtggtgggcgcctataatcacagctactcaggagaccgagacaggagaatcgcttgaacccgggaggcagaggtggcagtgagctgagattgtgccactgcactaccgcctgggcaacaagagcaaaactccgtctcaaaataaaaaagaaaagaaaaagaaaaatcttatgttttcttactcttggaatgaagaaatatgcaagtacgaaaattcatgaggagattcggtaggtatctagctctgattaaatgatttattagaaataagaattagtgaaatcaaccactttttaagttacaaaatattacaatgatcagttttaacctcaccccctgccctgaatgaactaattgtttttcttagagccaggtaagggcctgccattggcaagcttgcaccttgagttagggttagagttgtcatgagtcaaatgccagccatgtcctcttctgccccccatgggggggcccaaagtgcaggagtgacagagaggaacagaggcagatgggcagcagggagatggactggcaggtacctgtgtcctcacaggtaattacgtgtcattccctctggatggtttctgaactgtgggaactcccccatgtgcattgatgggagaagagccaggcagagacacggtaaggagggcaagttatccatgtgaccttagggatacttggggcaaaagtaggctaacctccgtgcacaccctggaacaaaatctttaaaagagagagcacagaagagagagagagagcactttgcccggaatgagccccataatcagacaccacatctcccaaattagcagcacccttggtttctgggcaggctgagtttcccgcgcgtcggaggggataggatgtagcggtgaataacagtaagactccaaaatcaagtgggtatgtctgacgatctgcctctctctcccccttacacacacacacacacacacacacatgcacacatactctccctcccccttacacacacacacatactctccctcccccttatacacacacacatgcacacacacattaacacacacacacattcattgctcttagtatatttcctccctacctccttaactttgaccattgacaaatttttctctcttaagaagtcttgaggcagtgcactcgggcataactcccttccttgtgatacatccacgtctttgtgaatgatgaatggaacgttgctcacttgttagtaattccaacagacaaagacgtggcctgagactgcccctcacctgctctataatggcttcttgcagcctgctttcctccctccagcgctgccgttagagcctgaggggtccaagggagtcagtctgcccccgtgagtcttcatgtggtgtagatgatgtcagggtcagaaactgacattcaacacgagctgaggcccatggtcccaaaaatgtgtgtgagctgtagttgtccaaagacgtgagaggacaagaggcttgagtcagggaaggccgacggagaagaaagcctggaaggagaggaggatccggggtgaagaagagaggaatggggagaaccttcccggtgcgatcactgcagaggaacagaggccgccatgggaaacacctgcagcgagcatcagcgaggagctgaaagtgctcaggtatcaaaagaaggcagaagaaagagcagcaaaaaggagagaaaagtcaacataaaaatttaacacgggtcccttctgctgacagaagccttcccagtgcctattgcggccaccttcctaatgtgacctcagatccaaatttagaaacagcctctgttccctccgctcccagactgttttttctgcttgccctgcattcatttcttggaagttttttaagtatataagagcccaggttggccagggcaggggttagggaagcaaaggaactggaaacctgtgtccgctgaattgcagagcaggaataagggactctgcagaaaagagcatgacaaagagccgcggatacaagcgagggtagcaggagaaagagctaagaaggcagaggttagttgtttgatcgtgcacttggggaaggtggagggagaaggggccgtgaagagatggaacggactggcagaggagatttgtgtggggaaaaggagacagaggggacaggaagaaggggacagaagagtaaagagcctggaagggccagggaaccctgcctgccatggtcctcccccacttcctcccacacaccctgatgcaactgtgactgccctggcacctcagcagcttcagaacagggaaaggaggagaacacgggtttcacaggaggagaagcaaggaggacccagggagctggggtgccctgtgattctcaaccctgtccacatgatctgacctgggggatgagagcttattagatccaacttgagttgacaacaaagaacttctggagcctttcaggcccttttgaaacaggcagatcttctctgcagtcatgtctaatgcagcaaagaaaacaacagtgtcccctgcaggtgcagggacttctggcctgagacagcagaataatcgctcctggagtgggaaggttggcttgtgtattgtgcgcggccatcagcagcatctcatttcagactctctcatatccccggaatgtcccggggttaccgaaaaggccccattctccttccacctgccttctcctgctgctagaaaccaggatttttgactattgtccctgcatccccacatgtcacccagaggcagccttaggccccctgtcctgggccacccttggcataactggagtagacccgggtgcctaccacagcctccttttcctcaagggcagctgccctctcggtgccctgctcactgtgagcaaatacatatttaaagacatattctgctacttcccaaagggaccagccaccacctgcactcctcgtcctggtggaaacagtctgagtgcttgctttggtaatcaaaggtttcattgagtgcagatgtagtgatcctggcaaaaccctggaaacagaaagtcagctgaaggggtgtttctggagatgaggaattgtgctggttagccacgggcatgtcctgaggataattatttgtttacaacatttctgtgaacaaagaacatatagggacagaaataagttagtttccaagaatcttgtgatgggctccatttatctgacccattgggtttgtagaagaggacagaatgctgctttggttctcctccttggacagtggaactagagaacgggaagctgagatggccgagctgagtggacagaggagggaggaagcccctcacctcgcctgcttcccacagggtcccttcctcctcctcctgtttcctaagcttctcagctgggcttcagatgtcaaggtttcctggcttctgccacttcaccttctcatcttagctgccactggaccataagcatttcaggttgctcagatctctcccaccgcaaaataaagcaaagacaaaaaagttctctctctctcaacccatacccatgtcctcctctggttcttcccttcacagtcaaatgactaaagaaagaagcagctgcactcacctctctgtcccctccccactcactcttccgtgtgtctcccacagagtggaatgagtgctcagggctcagccacccagcccctggggaacagtatgagtgtcttccccatgttatacccccgggggaaggtatgagtgtcttccccatgttatccattaggagacgggctttgggagattgcaaggtttctgcagtgccagggatggagggctgtggttccaggtattcctctctgcaaacacctgctcttgatgggggctctgctgcccctgagcccactggtaactgtacttggcccccaccacacagcaaaactctcacccatcttaccagcagtcttctcgccctggaattcactggtgcctgttttaggctgcctgggctgccatggcaaaataccacagactgggcagcttaaacaacagacgtgtgtatctcagagttctggaggctggaagtacaaggtcaaggtgccagcaggtcggtttctggtgacggctcacctcttgtgtaattttgggtggacacaaacattcggtctatgtgccaatctcctcaggcctcctgtggcagaatttgaggccgctcacccctccctcttcctcagtccttggttccacaggccctggctgccctctggctgcctcctggccacttaggaggtcctcaggtgctcagacttgattggatttcccagtcccacccaaggtcatcttctcttctcttgcgcactcaccctgggcaacttaacctactacggcaactactgcatcggctgctgccacccaaaacgcgatacactgagtggtggcagaagcctccccaggaagcctgttagaaacactgactcgggacccagcccacaccctgatcagtcagaagcctcgcgtggaggagatctgcatatgattcgtgcgcacactgctgagacacatgaacctcaacaacaaggctcccgcatcacatctctgttctggacctctgactcgggtgtcagacctgtgtgctgctgtctccggggaacgtagagggccctcagacacagtgtgtgcaactgatctcatccgtttaatcccacgttggccccacgtcctgcctgcaacatcagcactttaggaaaaacaccattgtcccctccttaccaggaccctggctagagaccttctgtctccctggcccaggcagcatcgccatccccctgcctttgggatatgtcccttccacttccccattgccactgcccagttcagcccaccttacctgttatctaaaaaaccacctctgcctccagggcctctttgcctcagcctccccgccccacacttcttcaatctgtgctggccacgctgccttcagggtgacctttctcagtgccaatcaggtaactcattcccaatctgcacctcttccctaacccccttgctgtcccacctgctccttccctctcacctctgggcctttgcaggcgctgttccctctgctgggagcacctgcctcctccactgacctcacagttctcccacgcccttccagcctcttcagcagcaggccttggactccacaggagtgggctcccatacccgtgcacacccacggggaccacagcactgctgacggttttccgatttcctgcctatgagtccccgcactccaagggactttgagatgcttaaaggtggcttgggacatggctgatccacaatagagcctcgagaaatatccgacccattgcaaaatggaccgtcccccacccccatgcggtttcagggccgctcccaggctgtgagtgtttatgtgaaaggagtgtttgccacgtcgctcgggacgcccatcctggcaatgagcagctgcagcttccaggattttaccttcttaaatgcacttctgttaagctgtgcatgtaagaggtctgttctgttgaaatatttcccagagactttcatactaaggagggctttattgttataaatatttaaacctgctttgcagccagtcgctacgattactcagctcagaaagcatgcacaaagcctgcctctagtggacgatcctgtgctattcatcggcctctcattttaaatgtcttcctgatttcaatttaaaagcgtatctttatataacatatacaatttaactttttctttttaaaaatatgtatagctagtttttgttgtgcaattctatgagctttaagacctggatagacttttgtaaccatcaccacaaattgggatatggaacagccccatcaccccaaaaaactccccctgctctgcttccttcagggcaagccctccctccacccctagtccctggcagccacagacctgtctacagtcttgtagtttagccttttctagaaggtcatataaatggcatcaagcagtatataaagactagcttcaaagtggagaaaactttaggcctctaaggcattttaatgcccgcatagtcttcatctttagggtaattttgctctaaaaacgtttttgctgttttggtgaaatatgtaatactaggatagactatggaagatgtgcttactgagttcttaccctcaatgtcaaaaacccaacagactttcattactgcatcccctctgtacaggatcaaagtgcccacccttagaaagtctgatgagacagagaagaatgacttgcgaggatcaagaaagacaggctgagtgagcagtgtcctggcctgaagcctctgagcactgcggttgtccctcagcacccctggggagtggttaccagaacccccgtgggtaccaaactccacagaagctcaagcgccttaggtaaaatagtgtagtatttccctataacctacacacatccttccgtgtacttgaaatcatctctaggttacttgtagaatcaaatacaatgtaaatgctatgtaaaaagttgttctactgtattgcttaggaaataatgacaagaaaaaatctgcacatgttcagtacagatgcacccatccttttctttcttcccgaatctttttgatccttggtggttgaatttgtggatacagatctcacaatactcagggccgactgtaattctgaaggagggggctttggggcgggagcctacaggaagctggaggcagggcactggggacttgaaagtgaaaaagtcagtcatgagcatgggagaaaggagaggaaggcaggggaaggcactccagatgaaagaaccccctaagtgcaggcttgaggtgggatggcacagtgagggcaggagagggatgatagatggtccacctggagcacagtatatgcagtggaggggcaagcaggcaggccaaggtggggctgagtgtctggagttgaccctcgttgccaccgtcttggagggagctgaatggttccagagtagaggctgatgccacgtgaccaggtgaggtgtcttgttgagaccgggcacagtgattcatgcccataatctcagcactttaggaggctgaggcaggaggattatttgaccttaaaaaaaattgttctgttgaacttattgccttgagacagaggagctttcccaggatggccatttcctacctgccggcctcagctcccatcgcctgcccttatgcccactaaacgcgcttgtccaatctcatggttaaggagccacgggttatggttttggccccatagatgagggagaaatttgctggagggcctgtgggagtctttggctctcttgcaagaggaatacagagttggcctttctcttccccactgtccttgccttcatgaagctgtgctgcccaggctgtcacggtgggacacggagcccagcccctgatggcaccatccatgtgttgctctcgatccctgttctctagattagctaagccagaaaaattagcctgatttgtctaagcgtctgcccatcgggttttcccttacttgccactaaacgagtcctgagtggctttgctcgtgctgtttcctccacctggatctccttctctaccttgtccagctggtgatctcttccatccagaaatttaacttcagtctgagtgagcacctccccagataccccaggcatcaaacacaatcattgcttacagggctgtgtccctcatcaaggagctgtgagcccctcatgagcaggaactgctccttacttctctttgcacctggaaggtcataaatgatcagcaaatattcgttggataaatgaaagaacaaatgaattccatagaaacaagcaagggaaaaatgggaaatgatttcatcaattcttgctaagtcacaggctttcttccttcacaaaaggatgcgcaagagagttgaggatcttgagtctgacaagcagagaggtgcttcttgttgtatttatcaaagcttcgctattaatccctgcagggtcagtgaacgcatgtcagctctgcactcagtcctgctgcacttcggtggactctcaccagaggtcaaaggctatcagctcactccttttgtctgaccaatgccttgggtggctgctctcatcctgacttgagctaaattgggtgatctgcctggagacttagaaccttattcctccccccaaccattcccactgcctttgccttgatctggactcttctctcctcttgccaggaccaatgctgccgctttccacctgtccttccctcctgtgcatcccacacagcctgcagctaagcatggttctgagcaagacacagcttcatgcaaaatattgtacctctgcttgaagacccaatgtgaacattgcccattgatttttgtttctcgatccccaacttcccatgccccaaaatagcatcctgggaccatagaaatggaattgagctttctaaaatgattctgcccatctcccactttacagatgaagaaagtgaagtccaggaagttgacattgcctcattcaaaatcatgtgactcattagcagtaagtcaagcctgtagcccagcttgtcaccagggctgttttcttcattacatcaccatgtctcttcctcttcactgcctgcgtgactatgtctcggcagtcaatggatacagcacagcattgccagcttgccatgtacaagggggacctgtttcagatattccatggagaccctggctggaggattgcaggagagtcccaggaggcaggactgccaatggcaccaggcttcgcagccatgcacctgcagccctcaggcagcactgtccattgtcatacgagtgtggcaggtgtgaggcatcgcatctgctcaccccggggataatgcacagcagctacaggcagatttcgggccagagagcaaccgagtgagccttgcagcctctgctgccagcacaggcttgttccttcaacactggtggagagagacacgctgtcatcaggcccaagaaatactgccttccccatcctatccctggtcactgggtgcccgcagagtgtcccagaggagggagggagggaccctccactggttcaaatggcctgttctcagagatgcagcaatggaccctcgtgaatactgaactgataatcatgggaaggagactggctctcctggattccctcatgattcctctgagtgacaatgtgatgttggccgactgtgtcttcttcagaatatcatatacacttgaggtctccaggagcctccaattacattattttcctggctcatacagtgacaagtaattcttatcctggattcctcgttactgagacttttcttgccttttttgttagcttatgatttattctaggacttcctccaacaggttatacttaactgtctacctcagtctctggaagttttaaaaatgttcagctaaataaaagaagtagattctccctggaaaccaaatacctatgggcctcactgaattaataatttatttatttctaaaaaaaggttttattaattaagtcaaaatttcattgtaattttaaaataatcttgtggtctttctccatgtgtctgaagcttgtaatcactcttattgtcctgtgaattctgatatgcagttacctgctagcttagtgggtaaacattttctctattaatgagcaggaggcttattaaactgtgacagtttagactattctttcaaggccattgatcagtgaaaaaacagaatctggatgctaaaaactgtgcccatgtgaattaatttacccccatctttccctgagccatcacctgagtatttgttcctaggtttgttggctgcatttgcttaatttttatcttgtgatttcattgagaggtgtagttgagtgggtgtacttacagcttctgttcctgtttgaaatatcatttggaaacctgatcacaccctgcacaagtatgcttgtgaggcatactaattcaataccatttgagcaggtgcctcctaacgctgccctcctcaacctttctcagcatgaatgtacgctttttcatgtgctgattttaacataatctttggttcacagtaacagagaattttgtttgaaaaaattcagggattgaagggatattgacatgtacctagtcaccatctatcactccatctcaggagcaagtgttccttgctctcgtgactttgtcctggtgacacagaattcatccttgtagaccacttactttcttcccaggctgggcagttctggcttttgcaaagttcttcatcagctaatttaagtctgctttttaaaacttcccatctgctgaatctcattccaccttttatgcggcagtgtccactgcgctttctgcagtgacggaaatggtctacagttgcactggccaagatggtggcattacccacacgtggctcttgagcatggggaatgtggctggtctgacaaaggaactcaatttgtagttttctttaattgtaatcaacttaaaattacataggccatatgtagctagtggctaccctattgggcagtacagttctaaagcaatgctgaatatttaacgaccttcagatatttgcagacagctctcctatccacatctttagccttctttggcccagccgaacaagtgtttcagatcatgcctctggactcctttctgtctccggacttcgtaacagcatggtcacccttcattcacctcattagatatctgaagtaatgacggaagtaatcgattgagtaaattagtgaatgaatatgtgattttaattcttcacataaacctcatcctagctaatcctcttgtcttctttataagctgaggtttttggttttatgactgtggatgggaagaggggatgcagaggataggaccaagcaaggtcgtattttctttaataaccacatccccacctgtttcccagttgggaaaaacacaaaccgatttgctctcgggtaccactagtttattataataagatgtacaaagcaaggcagatgaccctgcagtgatagcagggatggtcacttgtttggcagaatggcccaggggagcatctctagccgtttcaatcccaagaaagcaccttggggtagagatgatgcaaaaccaacctgtacatcgaaatctattttttattattcaaaaattacaacctggtcttctgaaacttatttttttatgcttttacatctcctacagccttacacataatttctagtgtctttttagaacctctcagtattgtaacatttaatgcgttctcagcagcgggtaggtccgtgttatgtttgcatttgaagtagaagagctaagctaaaaaatatgcctttgtttactaataaggtagatactatttttttgttgctgttgtttgatatggagtttaactcttgttgcccaggctggagtgcaatggctcaatcgtggctcactgaaacctccacctcccaggttcaaacaattctcctgcctcagcctctcgagtagctgggattacaggcatgtgccaccacacccggctaattttgtatgtttagtagagacggggtttctccatgttggtcaggctggtctcgaactcccgacctcaggtgatccgctcaccttggcctcccaaagtgctgaaattacaggcatgagccaccacgcccagccgatactattttttactcaaaccaaaaaatatattctgcgagtaagtgatccactgtatctcagcccataatgatggcctcgacaaggaatgagatggccacagtcagtgtcacccactggaccacagtgatgggcgtggtgaaccaagaagtgtggacatggcactgtgctgggttacagtagtgagggaagcaagcttagactagggagcaaaatcaacctgtgatgagttgtgccttcctttaagcatcttggcatttgttgttggcattgaggttatagaccggtggtgcaaagacgaggccacaagggccactggagaagagggaggagagcccaatggctagaatctggaaggacagccacacgtttccccctctgattctttaattcacccacaacatatgcccatggtgagttcttcaattgcaggcttttggtacaggaaatgagctcttgctagagatttaagacggagtcaaatcatgggtctagccctaatgatgagtaactgatggtgaggatgagagttgtgacagtgctggtggtcatgaggaggatgaggatgatgaagaagaaaacagcagtaacaaggacgatgatgaaaacctgctaattatggtgctgatgccagggataattatggtagtgataatgatcatgatcccaggaggacttactgtcattatttctcagtggcttttctttgggtagagagtgagataattaaagtctggaaggagacaggaacagggggcgtgcagttcctcagatccatgggtcccgcccagctgcatgctgggagtgaaactatcaagattaagagctatgctgtttcagcagcatttccactgtctaaatataaacagcctcaggccctgatccagcagaggagaccacagctgccaaatgcatcgccagctgcaggccctggctgggtttctttaggggaaaaggccatcccaccatggacaggttccaaaaggcatgagcctgcgaatagaatttgaggttcaaggaatgctagactgtgcgtctgtgttcagggtcacagagcgagtctgaagggagcaggatgaggacatgggtgccctgcctccagggcctgtgctctctgctggtacagacaagggcctggtgagatggtagaacaggggcggctactgcagtggtgccacctgcgtaggaagacgggaatctagtggggatgggcaggggccaggctccctttgctttcgcaggcacccagctccagtggcccctcagtcccagctacagatggactttgagatctgatgacaggatctgctgttatcccacctctggatcaacggcgccatcatcggtgccccagctagccagcagatgtgggccagagtaaggcttgactggtccacatgtcctttctggcttaagacactgcttatcttgactcagggagagaaggaaatggaagaagaagaagaaagaagatgcatttaaaacatattaccaaactaatgccatgaacacatgaaatgtcagccttttgattccctcctgccaatacgcatccgtttatccagtgctgacttactcagccctgaacatgcaccaggcgctctcgcaggcacagggaatactgtggtggacagagccggggaagcccctgcgctcgtggatcttacatcctgctggaaagaccgtgcataaatagatgtgtttatcatgtgtcaggcaggacacgtgctccacaggaaagtgacgtaaggtaaaggacagggagcaaaggggagtgtctgggggaggacggcagggacggcagggacggcatggaagcagtggcccagcagacgcaggacaaggtcctgtgatccgaggaggggtctcagggtggagggacagggagcaggccagcgtggctacagtgcatgatgtccaggatgagcaaacggagtgatgtttgaacatgtcatccgggaaaactacacacaggggcaggctcacagccactttttccccagctgatcttgcttcctctgttaccaaaccaccctcaatacagcctcgcaaactgagcaacagaggagggggaacacaactaataccccatttggcaggctggctgaaggctgttgaagaaacagcagaaacacctggtaatccttgcaggcgtcacccaggctgcgggccggagctgtcatgggacaagcaggaggctggaatggagctgggatgggaaggaacacaggccatcagcttcccaggccccacgttaattgtgtaatatcatcacagcagggtaggatgccctgtgagggcacctaacaggtgttcatcacattcatcagcattgccctaccaacgaccgtatttacatcaggcataaatgcagtttaccgcactctgtgagaactggggattaatagctccggtccagctagattctgatttccttggtaggaggaggcagaacagcacacatcttgactgaataatcgtgcattttgcatggttaataattctgagagcaggaaagctaccttcctaggatcacagagagcttactttcttttctacgaatctttgaaaaaccaaacagatgggattttaccttaagagttagattgcactcttacactgtgctgttcaaattatgaattggcctcacttggatgttggactattgattatcaactctggcaagctctttattcagaatcttaggacatgcacattaaaagaaaaaatcctctctttgacctggttgccaccaatgtgtatctacataggatgaaaaaatgcatcacgtactcagaagaacgggctgcagccccggagccccagtccttctgccagctctggagcagggggagctcctggctgcacctgaggtgtcagtctccaagaacctgagccctttccacacgcatggctctgttctaggcactcgggggagctcaaacagaaagagagtaaacctgctgctgttcagtcagagacccaagtcatactcacaaatgatcaagctagtgaactggatggcattttcacagctagatcttgtactgcaattatagattgtcaccataaagcttttgagagcaatttaatagttaataacatcctaattctatgatgtgagtaatctgtgctctgagaacggcctacatataggcagaagaaccatgaggagctctcaaagaaaatgtgccatatattcaggcacctggggagtggttgtagaaagtgtgaccttccaaggcaattgattttggttgttctttaaaggatcactctagcagtccggtcattcttatgggtcctctggtctagatgcccctcatggaggatcttctaatcttgcattattagaaatggcagctaagtggattatggatggaaactttcatgttgtaaaaacacaccaccagaagtcaaccattcttattttgcccacgtattaatgctatttccaaaactgcccgacagctcacgggtgtaggggtttaggggtctatattccttgttagactcaagctccttgaaggtagggaatgtgtcttactcattactgtatcctcagtttcttgccccattgtgcaagctaaataaacaatgaatgaatcaatgaatcaatgatgaataaaaggaaattagttaaattccccttagatagcaataattgtccttctcaccccaggttatctacagccagataccatttggattattgaattcctaggatgttccttgcctctctgattgtttgccatctaatcatatccactcttatgtttttatttaacttcttagtatacatacctgattcccacctttaagtatcctaaaggaacacaatgccttatcttgctttccctccgcccttggcacacaccacctaccacaacgttgaacttacagtaaacgatcaaggacaagtttcggactaatgcatttggatggaatggcttctgtggctttcaaacagaattctagatctgacctagaccagacccagatcctgcctggatgtcaggacttccctgtctctagagaggcagcatgaacagagacacaatgccgggcggattgttctgacctggctcccagacccaggccaggggccagggtgtgtgtataagggcatttgtattctgatggcctttgtgggttttttaaaccccaattgtatcattgattttttttttggcattgacgttaagattttcattcaatggtgatggattttaaaattgccctgccatgtggggtgttactaaagctcatgtggatgaaggctgttgaacgcctgtgtctgtgctcacactggctgctttgctttcctttcctgcctgacacgtcctctccatcttccccttctccgttgccatcttcctgcccttgtctcctgccagcttcctccttttctgcactcagccttaccctttcttccccttatgcttcctttctgggactcccaaacccaactgtgctttagagaaagagtcctggactcaacgccagggaaatgcatgcccgtgttcctgccttgctgccttctactctgaccttgagaaggttatgaactcttgggcttccattttgccatctctcaagccagtgagttagaccatggatgaaagaccgcccatcctaggattataaactgggtaagatttgcatcaatgtgagtcttcacactgatgctggctccaggtttcctttctccactgtgagctgagttaaaaactctctattaggaggcatttcacataccattgtcgaggaggtgggaaataacaattccattcatttgccaagtagaaaagcccttgccttcttggttcattcagcagagggaaaagtaagctaggcggaggcaggaatggcctttatttgcaaaggaggctgtgcctcactgttcttcaacaggatgcctaatgagttagaatttgagtagcatggctgggtgcagtggctcacgcctgtaatcccagtactttaggaggctgaggcgggcagatcacaaggtcaggagtttgagaccagcctggccaacatggtgaaaccctgtttctactaaaaatacaaaaaaattagccaggcatggtggcaggcacctataatcccagctactcaggaggctgaggcaggagaatcgcttgaacccaggaggcagaggttacagtgagccaagatgtgccgctacactcctgcctgggtgacagagcgagacgccatctcaaaaaaagaaaggttatgcctcacaggttctgacattcagtaggatttgcactttggtgcatttttctttgtacataaaaccctcatctcacttttagaacagtgcagtacttaactttttccaggattaggtattcatttcagtcatgaaaaagaaaagggcatttgacccaaattacaaaaactattgaagtaaaactgccctattttttccttcatgctttcattgcaaaatgcagtgactgtctgctgctggatgagtgtgtatttgggggctctgagggatggagaaggagaggcacgactcgcaagtgccaggaattcacattccgctgacgcgggaacacgggcagtgtatagacattgtacagacattgtaaagacattagagcacaattttgagaaaacgtgaaaggatttccacaagtctttatgtcctctgtatattaaggtgttaagacaatggatagcaagagaaagatgggattttgtggcagaaacttccaaaaaaaaaagttgacatggagcaggtcctcaaagcaggaggcctcagagtactttgtagtttaagtaggagggaggactcgggtatctggagatgggaatggaattaccagaggagaggagcattgaagaaatggcgtcaacactgaagaatgtgctgctttataagaataatgagcccttaaatgccagtctgaatcttagcttgacaaatgaggcgaatctgaacacctttgggataataatagcgccttgctctatttgagataaaatccatttcttctgacttctgaaaggaattattgtattggtccatttgttttattttaggaaattttaaaatatgaggtagaaaagtataaagtattctccaagttattagctaataattggctgatgtcacccaggtggttatataataaactgtctcagtatcattaaattctagaagtccagaagaagaagtcaaggacttcttagtattttgaggcagagggaagaactacaaaaaaacctcagggcaggaaaattggacctgttgcaggccctgaaagctggtgtgatttgagtacagtgagagagagacacagagacagagagggagagaagacagagagagagagggtggggagacagagaaggagagaagacagaggggagacagagagagacagtgggggccagtaggggaatggaagcacaattgtgggttggtgtctcctggctcaatgcctaatgagttagaatttgagtagcatggctgggcaccgtggctcatgcctgtaatcccagcactttgggaggccgaggcaggcagatcacagggtcaggagatcgagaccatcctggctaacacagtgaaaccccgtctctactaaaaaaagaaaaaaatacaaaaagttagccaggcgtggtggcaggcacctgtagtcccagctactcaggaggctgaggcaggagaattgcttgaatccaggaggcagaggttgcagtgagccaagatcgtgccactgcactccagcccgggagacagagtgagactccataaaaaaaaaaaaattgagtagtatattactttgctagggctgtcgtaacaaagtgctacagactgggcgtcttcaacaatgaaaatgtattgtctcacggttctggaggccagaagtcagagatcgaggtgtctgcagggtgggctcctgctgaggctgtgagggagtgctggctccaggcctccttcctgcatctggtggttttctggcaatctttggtgttcccaggtgcaccaatgcatctccagcctctgccttcgtcttcacatggtgctctccttgtgtgcatgtctgtctctgtgtccacattttccctgtttacaccgacaccagtcatttggataaggatcttttttaatgacctcattttaacttgatcacccctgcaaaggctccacctcccaataaagtccctttctaagtcctgaggataacgactccaacatgtcttttctaggagacacaattcaacacatagaaaacagttaagaaaaaaaagagaaaatttggtaattgtcttctgtacagacttctattaaaacaatgaaatgtttatttaccaaaatcaggaccaagttacaggccagtattaatatatgaaactgcttgcgtttcacatgtacacttaaatttccagtcctgattttcataccaagaaacatggccaagtcatcacttcataaaggaaaaccgttttggaaggtaaaaaagacaattactgtttgaaacagtctaacattgaactttagatgtaaactatgccgagcaaacattttttccaggtaacgttatttgttgcagacagcctttggccattgtgtagatcccaaatgtggtgaaatgggagctcccagatcattgcccagtttccagctgccatcccgagtttgttggtgtcactgattccaagaacaaaacactggtgcatgaaattaacaaccttataaatagatgacagcacgtctgttagacaaaaggctgcagttatcccctagaaacaatcaaacacaattccagtaaaagtcttgccaaatacctctttgtaattcaaggaacctaacaacagacaatatgcagtgcctccttgtttatgttctggaactcagcgctgctgcagtgtaactgagaacaggctagtacaacccacaggcatcttgaagtgtgcaaggaggctcagagaggtttatagcattgttgttttgttttgtttttcatggttctttatgtcattgtttgttttataaagtgttatttatagtatgttcatccttagggacttttccttgaaaccaccacctttaatgctgatgattggtgttcccatggaccttgggttaagggggccaaatggtatagatgccctggggagagcttgctattggcctttgggagagaccctgcagcagtaggtttcagctctcccagtggcagagctgggtgataactgcactttcttctaagggcgatacattttgggaatgtgcgtggtgtgagttttctgccagcatctttatagagcaatgtgtacttgcaaataaatacaaccaaagtcaacaaaagagcatattgatgctttggtagagaactcagcagtctcccctctctgtagcgtaaaatccagggaaaacaaaggccccacaatggggacagatggccccgcataggtctaaggactgccattccgttttaaagttataaagtactctcacactgtttacctcttttatttcacaaaaccaccgcattaagtggacagggtagaagatattatcctcactttttatatggagaaaacgtggctcaggtgacgaggtgaatatttgtgggtaaggcaagaactttctttctttctcagtcagttctctctactcaagtggacttctttttattattattattattattattattatcattatactttaagttctagggtacatgtgcacaacgtgcaggtttgttacatatgtatacatgttacatatgtatacatgttggtgtgctgcacccattaactcgtcatttacattaggtatatctcctaatgctatccctcccccagccccccaccccatgacaggccctggtgtgtgatgttccccaccctgtgtccaagtgttctcattgttcaattcccacctatgactgagaacatgcagtgtttgattttctgttcttgcgatagtttgctcagaatgatggtttccagcttcatctatgtcccttctaagctgaccccactccttcctttcatggtaggcacacatgcaccgagtaaaatggctgaatctgggctccaaaatgttctcttcagtcccgcatgttttggcaaactttcctctctgctgtggcacttcaatcccgctcttctccataaggtctatccttttcttcataaaactttctcatggatggctccagtcccaaataaagctatcctcctgctcctggcttactccaatttcccagctcttttgggaaatgtaaactttatggtgtcattattccttttatgtaacttccttttttcttttctgagatggagtctcactctgttgaccaggctggagtacagtggcacaatctcagctcactgcaacctctgcctcctgggttcaagcgattctcctgactcagcctcctgagtagctgggattacaggcacttgccaccgtgcccggctaatttttcgtattttttgtagacatggggtttcaccatgttggccaggctggtctcgaactcctgacctcaggtgatccacctgccttggcctccgaaagagctgggattacaggcgtgagccaccatgcccggcccttttatgtaatctcttatcctgtcccaaagacaattttataaaataataataagtagcacttttgggtgattaataggtgccaggcaccatgtcaaaaactttctgtccagtatctcctttaatcttcacaagaaacctattgtggtaactcttacaccattttatagatgatgaaaccaaggctaaaggaaatatgatgaaatgtccagggtcactcggctgggaatttgggaagccaagttggaaactcagatctactaattttcaaagcttgcacttattttaaagtaatggcatatttggtttgttgtcatagtttaatcatgaactgtttcaagtgtacagaaaagtacagatggcattacttaaaaccacttgcagccaggcgcagtggctcatgcctgtaatcccagcactttgggaggctgaggcaggtggatcacctgaggtcaggagtttgagaccagcctgaccaacatggagaaaccccatctctactaaaaatacaaaatttgccaggcgtggtggtacatgcctgtaatcccagctacttgggaggctgaggcaggagaatcgcttgaaccctggaggcggaggttgcggtgagccattggactccagcctgggcaacaagagcgaaactccatctcaagaaacaaaaacaaaaacaaaaaaccactcacatccagaatgctcaaatttaacaagtgtgatctgtcttgttgaatgcgtccagggtcttgaaggtgtgtatgtatgctgatgcacttggatgacctgttgtaaagtatgtcaattaggtcaaattagttgatattttgttccagtcttctatttaattacttttgctgtgaattactgtgtaagaagtattgaaatctctcattgtatttggagatttgtctagttctcttttcaaatctgtcacgttttgcttagtaaatattgaagctctcacagtaagcacatatacatttaggattttcttgtcttatcattgaattgaccttttcatcattatgaaatgtccctggtagtattcctttgtctctgttaatattctgtgttcttcagtccatttgtttgataataaaccattgcagctttcttttgattcatatttgcctggtagaactttttctatccttttacttctaacctcttcatatgtttacatttaaagtatgtttcttataaataacatgtagttaggtcttgctttttttttctttcagtgagacaatctctatcttttaaaaagaatatttagagaacagattagcaaattatggcccctgagcctaatttatcttagtgcctatttttgtaaataaagatttattggaaaacatccatgagcatttgttaggtattgtccaaggctgtttttgtacttccaaagtagttgcaatacagaccgtatggcttgaaaaaccaaaagcatttattatatgtccctttatggaaaatatgtgctgactcctattttaaatgttacatttgatgtaattgtcagcatgatttaattgaaatctaccatttgctattaggttggtgcaaaagtaattgtggttcttgccagtaaaagtaatacttgtttctttatgcttctctcttctgatttttggttcaatttttcctgtcctcttttggctacttgagtttcttattattccaatttattttcactgttggattaacaagctctttgttttactttttaatggttgatctatgtttacaatgggcatttttaagttatcacagtttatctttgattgatggaccacttttggtatatcgtgtaaaagcctacagcagtattcttccatcatttcaccataccatcctttctgatattttgttgttcatttcatttctacatatgtttaaatcccataatacattgttattatttgtagtttagaaaatcaactgtctttaagaaaaaaaacagctttatatttatctatttcttaattcttgtttgtttttgttttgttttgagatggagtctcgttctgttgcccaggctagagtgcaatggcacgatcttgtctcactgcaacctctgcctcccaggttcaggtgagtctcccgcctcagcctcccatttctcgagtagctgggattataggcacccaccatcatgcctggctaattttttgtgtgtgtgtttttgtagagacagggtttcaccatgttgaccagactggtctcgaactcctgacctcaggtgatctgtctgcctcggcctcccaaagttttgggattagaggtgtgagccagcatgcctggcctatttcttaattcttaatcctttttttttttttttgagacagggtcttactctgtcacccagcctggagtgcagtggtgcgatctctattcactgcaacctctgcctcccatcttaattcttttttatagaaacgaatttcctctggctttattttctttctgtctgaagaatttatttaacattgtaatgctggtctactggcaatgaattctctcaacttttgtttatctgaagaattatttcgctttcattttttaaagtttttttgctacataaagaatttcaggtggacattatttttctttcagtacttaactatatcattccttgtcttctggctagcttagtttctgaggggaactctattaccattctcatctttttttcctttgtgtatatgtttcttttctctcttgactcattcaagattttatctttatctttgattttcagcagtttgaatacaatgtgcatagatgtcattctctttgtatgtaatttgtttagagtttgtgaactttgcacatctgtttttggtagtcttccattcagccatgatttcttcatgtgtttcttctgtcccatcctctcttgtttttccttcggggtctactcttacatggatattcggccattttaatcattccaggctggctgtgtgcggtggttcatgcctgtaatcccagcactttgggaggccgaagtgggcagatcacctgaggtcaggagttcgagaccagcctggccaatgtggtgaaaccccatctctactaaaaatacaacaaaaattagccgagctaataatcccagctactcgggaggctgaggcaggagaattgcttgaaaccaggaggtggaggttgcaatgagccaagattgtgccactggactccagcctgggtgacgagagtgaaactctgtctcaaaaaaaaaaaaaaaaaaaaaaaaaaattatttcaggctctggactctctgttcttcttttatttacttatttactttttcttcttttctcataaatataatgttaagaagtagaagtcagacataaaagaataaaactatgatggttccatatctgcaaagtcaaaaaatgcccaactaatctatgaaaataaaagtcaggttcggatgtagggttagaatgtaatgattgataggtgcacgtgggatttcttagtgtctgataaagttctgtttcttgatttgcatggttgttagaccaggtgggttcactgcaaaacttcatggaactgtacacatgatttgtgtactttttctggacatgttattcttttacttaaaagtttattttaaaaatcaaaaatagctttccgtgtgtttttcttctaaaagtcatacattttgtttgggtccataatcttttcagaatgtatttttatttatactctggagaaggtaagtttatttttctcctacaataatagtcaactcttcatcatgaatgttgcatcatttcctggtagtttttatcataatcttggccatgtatgcacgatccttttctcgtctttctcttctgttctatttatctatccttacacaataccacacattagacattctatagctttatgacaaatctttgcacctgatatggtcagtcccttctaattctcttctttaaaaattgccttggctattatttgccttttactcttacatgtaaatcaggaaacagcttttaaattttattaaaaatcctattgaaatgatattgaattgagatactaagttggagagaattgactactttatgatgttgaattatcccatcctggaatatgctagataatataagcacaaagacttcttttaagtcttctaataaaatgttataatattcatcatagatgtcttaaatataatttagaataattacttctgcataattttaaaatagggtaaattagtgcttctttttaatcacacactttgcattgagtgttaccagtgaaaggaaatgctaaagactcattagtaggaatcttgtatatagtgaagttaccattttcttgctaagttcaaatggttggattctcttggatagtctatatggacatttgtaaacaatgacggttttgtttctccccgtccttgcctatctcttttgtttgtttgttttgtgtcttcctacactggctactcttttccatccaatgttagcccagaaaccatgacagcatgcactttagtcttcctcttaatttaaaatgaatatttccatattttcatgcctaagtgtgttttctgtatgctttggtatctcttttttttttttgagaagattaatatagatctcttctatcccttgttttaattttcatattttgaattataaatatgcactgtgttttcaaagaatttatttttctttgcatatagaggtgatcgtattgttcctttttgtttaatctactactataatgatttacctaaatgaaatgtccaatattaaaccaaccttgattatattcctaaaatacaccttatttaaatatgttattcttttttaaatatacattgacagatgtactttgagggtcctcatctttatttgtacatttttagtcagttttacgagcaagagggtatctgttccatctgagcttgatcctctgatgattcattaattccttttaaactactgtttcacttcctttaatggttatacttctattcaggtatatttcttcctgagtcaattctaagatttgtttagaaaattaccaattacatttaaatgttcaaaattatttaataaagttttgtatattttcatattatatttttctactaattacattttcattttctgtccttatagtgtttgtcccttttctgttttgatcttgatcaatttttatataattttgcatgttagtactattctcaaagacctatagtttggttttcattttctctttttatctttgcttaatctctcattagtacctactcttattgattgattccttctttctgctatctttgcatttaatctatttttaaatttttaagataaaatatggcacatttattttcagttttctatcctttctatgaaataatgggtacaaatttttctctattattttagctggatctgtgagtcttgatacggagtgttcattacattcaatgctaaatatttcatattttgcattataattttttactcatgtgttattttgtttccgaatatatgctttatttacccttttcacaaaaagttgttgattataataaattaggaattttcttaatttattacaatacaatcaagagtttactcagtttgagatgaaatttctgtatatttgagactttgtatttgatcaattttcatgacaaggattaatttataaccattgaaagaggacccttcaattggccactggcttattagttatattgttgcaatattctctatccttactagatgttagtctctatgacctatcagtttttgagagcaatgtattaaacatcttataattctatacacttttgccttatgtattatgaggccatgttgctaaatgcctacaagttcaggattgtaatcacttcctgatcaattatttctttttatcattaactctccgtattcctagcaatgaaatttgtgtgtctttttgtttccatttctattttctcaaagttatatttgtctgctgggagtataattgcactagtttttgttttccttttggttatttgcctggaatgtgtttacctaacccttactttacacctttcttggcccttatgatttaattatgtccttcctgaattgcatatgtttttaaacatctaacttaaaggaatttaacctgcctataattagtatgattacagttgaataacaggtttgaactgtgcaagtccactgataagtgaattttttacaatattttagaataatttttggacacttatgacaatttgagaaaactcacagatgaactgagtagcctagaaatatcaaaacaattaagaaaagttagatggtcataaatgcataatatgtagatactagtcttttttgttattttcttctataaaatatacacaaattataaaaagttaaaattgatcaaaacttttatacacacacatacttatagactgtacatggcagcattcacagtccagaaaaatgtacataaatgtaaagatacagcattcaaccacaactgcgtaagattaactgtggtgcatactgtactgttgtaataattttgtagccacctgctgctgctattatggtgagctaagtgtggtagattgcaagtagctgcatgaaatgccacgcgatgccaatcatctccacatgagcagctcatttctccagtaaactgtggatcacaggaaaaagtgatctctcacgtatttttcctcatgggtagtgcaatacagtaaaccttaaataaaactatgggacacatatgaagtgccactagtaatgctgggagtgttcccatgaagcagagaaagttaggacattgcaagaaaaagttgagccgggcgcggtggctcacacctataatcccagcactttgggaggccgaggcaggcggatcacgaggttaggagattgagaccatcctggctaacacgctgaaaccccccgtctctactaaaaatacaaaaaattagctgggcatggcggcgggcgcctgtagtcgcagctactcaggaggctgaggcaggagaatggcgtgaacccaggaggccagagcttgcagtgagccgagatcgcgccactgcactccagcctgggcgacagagcaagactctgtctcaaaaaaaaaaaaaaaaaaaaaaaaaaaggaaagaaaaagttgaattgcttgatgggtactatagagtgaatggttacccaccatgttagacagacgattcatcttgtaaacagaaaacatgaacttattatagtcctgtaaatgtattttcttttccttatgatgtttataacattttcttttctctagcttgctttattgcaagaatacagcatataatacctataatgtgctaaatatgtgttaattgactatgttattagtaaagctattagtagttaagttttggaggagccaaaatcatacatgtatttttaactacacgggaagttggcatctctaatctttgtgttgttcaagggtcaactgtactggtaaacttgaactattcctaaaataatatttagttttttcttttttttttctttttttttttgagacagagtctcgctctgtcacccaggctggagtgcagtggcacgatctcagctcactgcaagctccgcctcccaggttcaagcaattctcctgcctcagcctcccaagtagctgggattacaggcatgtgccaccacacctggctaattttttgtatttttaatagagatggggtttccctgtgttagccaggatggtcttgatctcctgacctcgtgatccgccccctcggcctcccaaagtgccaggattacaggcgtgagccactgtgccccacctagttttttctaaataccatgcttgcattttttaggagtgatcatatatatatatatatatatattttgagatggaatctcgctctgttacccaggctggagtgcagtggcgcaatctcagctcactgcaacctctgcctcccaggttcaaaggattctcctgcctcagcctcttgagtagctgggactacaggagcgtgccactacacctggctaattttttttttttttgtatttttagtagaggtgaggtttcaccatgttggccaggctggtcttgaactcctgacctcaagtgatccgcctgccttggcctcccaaagtgccaggattacaggctgagccactgcgcccggccgatcatatgttctttgttgctgttttcctttccagtcatccctgtactcatttcatgttattgctcttgggtcttttgattccatcattttaaccttctgtcaattagtcataataatcattactgatttatacagcttaatttatacatattcaataattgattgctaatcgttgacaactacccctcccttctgaatttggtcacctttaggagtcatctccgtgaatatctgtgactgataaactgcttcagttcaggtagatggaattttctagttccagtcccgttttcaagaaagtttaatctatgtatgggtactggctttattaagggtcaacagttttagatcctaaccccaggagggcccaaggcactcaccctgtttctgtaaggtcatcacaacctcagaccctaggcctgtattcagacctgctgccccactagctgcccagactttcgccaaaactcaaatgttctcatcgtgaatttatcttcacttctggcatctagatatttcccttatttcgcactttacgtattctcgaacagtttcgttatgttgtatccatgtgtacgtaataggagggtattctctgttaacttaaaacagcatgttgcaggaacccagtactatctttctttgcattgcccatgcaagtgagccctgcaatataaccatcttgtctgctgagactttcttacacattttcagagtattttctaaagaagtcatcacatctaagatgcaagcttacaagcgagttcactaggggatttactctgtagacatgttgattttgatctaaatttaatgcccttgtttctacaactgtatttgtttactcttttgtgcctgtggtataatacactatcttatactctcaagcatttcaatacctcttccagtgtttctagatcactctgtctctctcattcacacacacatgcacatgcacacacatatacttttacacatgcatgcacacacatacatgagcacacacacatttacatacatgctcacacacagcacacagtgggacagtctgttcacaaacactacagaacaaacttccttgtctgtaggaagatatgtgtgcacctggcctctttgctgttcttacgacttgcccttcccaagttatttctactttacctctgtggttcgtttgatagaatttccagttaatgtattataagttataatatgccttttctggaataaatctttgctttcaatagatccattcactcctttccagaaatgatcgctgctttttatattctccttggaaaaacaaaagcacctgccttgacccttgtcttcaatatcacatataaccatacaaaactaaaaacaatccattcatttattcctttggttaatagatttttgttgggcagctatcatgttgtatgcggtgtgttagatgctgggtatgttctatgaaacaaaatagtctctgacccctggaagagaaagaaagaaagaatatccctcgccttacctttcttgacccatagtccaactgaagagagaagacgtctgttaattaactaacaatattaagtagcaaattctgagtaccaaatgagtggtattgagatcagctgcctatttgtgggctgatatggttccaaatggcttcacttgacagccttgaaattgagtcttgaaaagggtgcagaaatctaggtaaaaaatatcgatggggaggcatttcaggtgggagaaggaaatgaagaaagaccctgaggtgttacatggggtcaaaagaaaggatgattcaaagcaaggagagagcagagaagagttgggctgaaaattgaatttcctaccacttgtaggtaccaagttgtgacaatgagcttgtcatttcttgcagcacctgtcttatgtagctaaaagtctctttgagttctgcaatggcatattgcttctacggccaacattctgtctttgatagtgaggtcttacattagcattaaatcaaatgttatattgaaccttgagtaaaatctcttccaatttatgttttttttttattatttgtgtctgtgttgttctctgtgtgtgtgtgtgtgtgtgtgtgtgtgtgtgtgtgtgattgtgcacctgtatttgcgtttctcatctggaaaattctcttattcttttcccagggtttgcactgattttcacccttattcactcatctgaaatatcctttttcagtttaatcccagcattttatgtggtgctagactttggcttattggattgtaatttccaacttctaacctctcacctttgtaagacattgacactgaatcatctttcctcactctcagtataaatggtattttaactccaagctggctgcctgttaaattcatttactgtgctagagtgtatctggtaacttgcctgtgatgaatttgtgtccattattacattatagatggtttcatgcagccatctctgcaaagggcctaattatagctgtgatggccaaaactacttgttacctcgtgtcttctgactcatgtgacttgtacatgttttgacaatgaacagttctaccctccaccatggttagataaggtggaatctttttgataggagacctatattagttcagataaatgatgttgcttgttacgtacgaacacacatcactttatctcgttagcttgggaaatggatacgggcagagtgtattattcattttatatctagtgctgagagaggggcacttcacacaaaatagtggttcagcaaatgtttgtgggatgccaaaaaagcccccacaacaaaaagtggacctctttggttatccaagagagatgttttgtcttttggttctagaaattttttcttgcttcctcatctctcatagacatcctagaggagtgtgtgcatgtgtgtgtgtgtaatattaagcaaccagccattctttaccaatagaagatatccttgtttctaacaatgagacttcttctaatagtgctaacactttatctcatgtatgttatttattttttgaagatatagctttgcattttggaataattggagactcacatgcaattttaagaaataatacacaaagatcccatgtactctttgcccagcttcccctaaagttaacatcttgcacaactatagtacaatatcaaaaccaagatgttgacatcaactaatcttatttagatttctccattttgctttcatatatgtgtgtgtgtgtgtgtgtgtgtggtgtatgggtgtatttagttctgtgcaatcttattatatgtgtaggtttgtgtaatagcacctgctgtggtttgaatgtgttcttacaaaaacatgtgttggaaatttaatctccactgcaatagtgctgggaggtacagcccaatgaaaggtgtttaggccatggattgatactgattacaaaaacagcttgagtctgtgagcttgctgtcttgcccttctgccttcctccagagacccttgacagatgtgggccccttgatcttaagctttccagcctccagacctgcgagccaatagatctctgttcattacaaattactgagactgtgatatcctgttttagcagcacaaaaaggactaagacaccaccatagtcaagatacagagcagttctgtcatgaggacccctcgtgatactctgacagccacagccactccttccctccctaacccctgacaaccatcaatctattgaccgtctctaataatgtcatttcaagaatgttatataaacagatttataaaatatgtaaccttgtaagattggctttttctgtttagcataactcctgagatccacccaagctgttcatgtatccatagcgggttcctttttattgcggagtaatattccatggtattggtgtaacagtttaaccattcactcatttatggatatctgggtttattccagttttgggctattacaaaggaagcttctataaacattcaagtatggtatgtgagtgtaagttttcatttctctgggattcttgtctatgaattcaactgctgggttgcgtggtgattggaagtttagtttattaaagaaacagtcactgtttcccagaaagactatgccattttccattcccaccagcaatatgtgactcagtttccctctgtcctcatcaacatgtggtgttttcattatcttgtattttaggcattctaataggacttgtcttattgggcttattgtcttatttgggctactgtaacaaattaccatagactgagtagcttcacagaagtttatttttcacagttcaggggaaagtttaagatctgggtgctggcatggtccatttctggtgaggtccaccttctaggctgcaaacttctgacttcttgttgtagcctcatgtggtgaagagcagagaggagaaacaagctctctcgttactataatgagggcactaatctcattcatgagagctctgcccttatgacttaatctaatcctcattacctcctgaagtccacagctccttatccatcagggggtaaggtttcaacatatgaattctggggtacacagacattctgttcataacaggtatgtaatgacatttactttctaaatggtatttgaatgttgttttgtttattgaataaccataaaccaaggagttaagggttgcagatgctgtaaaccttatttaacagatgaagcaggctgggtgctgtggctcacgtataatcccagcattttgggtggctgaggcaggcagatcacctgaggtcgggagtttgaaaccagcctgaccaacatggtgaaaccccgtctctactgaaaatacaaaattagccaggcatggtggtgcatgcctgtaatcccagctactcgggaggctgaggcaggagaatcgcttgaacccaggaggcagaggttgtggtcagcagagatcgtgcaattgcactccagcctgggcaacaagagcgagactctgtctcaaaaaaaaaaaaaaaaaaaaaaaaaaaaaaaaaagtagatgaagcaagttgctcaaatcagacacttgtttgagtcacaaaataatcaatggtagagctttgtctgcaaccctacattactccctcattgttttatgttgtcctgattaaattgagcttctaactgataataaaatctattattcccaaaattgggccacccattccccaaacgtcctaccttcattctagaatgtcaaacacaagccacagctgagcagcaggacctccatcagcatgcaaccacatggccagccacgccctgcgccaagcctccagatggagaggatttggtgggaaatcatttctgctgctttccgcattccgcatacagtgtcttcttttaacatggcctcttgagagccactctccagcggcagcacggccagcctctgtgcctccactctccaccccaccttgcccatccacagctgtcttccctttctcttctctctttgcagctattctcccttcccaatccagcacagcagtgtggctctccttcctgtacactggtctcctattttcccttctctcatcacataaatcaggctcacatagggttagcttgcgttagcttcttttaactggttgttctgttggttttaattttcctatttttgggattggtttaattatgggaggagttagaggctattttaatgaaataattatggaattagcctaggttttttgaaagaaagaggaaggaaaggtgtgttccattctgtttgcattttttcttctgtatcaagctttgatgtagctttttttccaggcagaatttaggtgcaaatggaaaggtctcaatctgactcaagtcagagtactgtgtgtggttgttctcaatggtttattaggttttatagctctgttttcttttcttgacaaagttatctcacctttgcttgaaaaccatgtttctctgaactatttggtggtttcatgattgcttgtgcttaaattaatgtcagcagcaaggcaatcagtagaaacttcaagtttaaattctcctgaaagctaactttaaatgttaatgtttcatttaattgaagcattctgagatattagcattaaccatttagagcacttttattagataaacggaagaagggagaaggcctaattattgtaagtcatttctgttagacatttatagagaacttgcctttgatgagaaaattgcaaaagaggccaagtatgtcaaatgttgttgtcttccaattcccatttcaatgtgcaaactaatcattcacttccctcatgggaccgctgtgagtttaactgggcaaatacatgtggagtccatgggtgaatctttcattcagtgcaggctacgttgggcgctgtggtcagctggaggcccctatttgacaagagacggtcagaacttagtgtgtgttttctggggctgttttgattttcctgtacaggagagttttgcagggaggcatattgggctggaaatcaaaaggccgtggttcttgcccatctttatcatgggtagatttctggagccagaaccagagccaaataacttcctgacctgcaaaatgaggaggcctggaagattatcctaacgagcctctttgctctgtagttccagcaattatatgtattctgtgaaaagccaataacgtgcaattcctgatagtgaaataactctggagcccatgaactcatgcttcataggccagccctacagattaggaaatgggtttcttcctagggtttttattcaccgtacaatactttcacattttctttccaaatgactattaatcacatattgaattttaaaatattataatccattttccctccagtttttgtggaaaaaaatgtatacacataacgtttattattttaaccatccgtaagtaagtatacgattcagtggcattaaacacattcacaacgttgtataaccatcaccactatctatacacaaaactttttcatcacccgcaacagatcccaatgccttttcaacattaaatactgacttccccttcccactgttaccattcacaatgttgtgtaaccatcaccactatctatacacaaaactttttcatcatccacaacagaaactctgtccccgttaaatactaactcccctttcctactcttaccattcacaatgttgtgtaaccatcaccactatctatacacaaaactttttcatcatccacaacagaaaccctgtcctcattaaacactgactcccgcttcccactcttcccagccctggtaagtctccctctgcctgaattccccaggagtttgcctattccaggtacctcgtacagtgtctatctttctgcatctggtgtattgctcttagcataattactccccctccagttttaggagaagcttcttcccaaggagatttttgataagaacaggaggcggccagctcagcttcctgggatgatttgggtacagccccacccagatgtctctaatttggcgttatcagagtcagtcaccccactgaaaagcccgcctacccatgagcttgggaagccctacatttacaggatggtcagctgtccccatgcccaggagtggttctgtctggagctgattcacagctccatcccctagaaactgtaattcaacaggtcttgggtaagatttagggatctgcattctaaagacagattccattgatcccagtgccttttcaacagtgaacactgtcttctgcaaacagctcacaattgtccatgaaattttgagcttaaggaagttctaacgcccccctcccctcctttatttttgagttgaaagagggtagaatcaaaaacaatactgagaggggtctaaaaatgcaaacacagagagttgctggtttaggagggctgggaggctatgggagaccataggcatagagaaaacattccttctctgtgactctcgggcgcgagcgaatccccaagggggtcaccagagaatcatttcctctttgggaatacaacatgagatggttctttcatctggacctaggttcaattaagtaaatagagcaaatacaaataagagaagaaaagcagcacaaacagtgaaactaggtctttacatacctaaggaggagccgtgagcattcgcctccagggaaccacagtgacgggaaacatgctggaatgttaaacgttccatctcatttgtaggaagcagatgcctacatcttcaaattttgtcttcttaaaaatattattttatccagataaaaatctataacctctagcaaagaaaaaacaacagctgcaagttggagatcatgaactgtctttccaaagaatctccacgtgtagctgatgtcagatgccatcagcagtcagccttcatcaccccaacgccaagtatttgttcagtttctgctccatatgaatgcatcttggatagaatgtgtttggtttggcttttaagaaggctcactgacttagcccatgacctaaagcatatacttaccaagccttggaattcctacagagggccctgcactttgtgtttggtacagagaccaaaaatacaaacccagctttgaggacagaagggcagggaagcaggctctttatgctgtgagtctctcactccaccccatggtccactctggaagcagaagaagtttctttggggatataaaatgtattgttggcaattgtttttgtgtgcagttaaggatcctggaattacagcatctaatgttctaactctactgccatatccatcttaggaatagaaatgcaattgcaaatggcaatttgaggtaagcaatccgattgtgcgaataggtcatatcagatggccaggaatcaagggtcatctaatgagactcactgaccacaactgaaatcagccaccagactctattttctctctgacaattgtgatatggagcaaagaacttcacctcccaccaccatccctgcccgttggtgactgctcgtgaacatttggttgatggatggacaaatgtatgtgtgaacaaataaattaataaatatgtaagagtattggttactggagtatgtattactagagaaataagcaaagacctgctccatacccttcccccaagaaaatagcaaatcattctcagttggaagactaaagagaaatgctagagtccaggccaatggaaaacaagttaaagacagaaggtttagtagcactggaaaacccaggaggacaaagattctccaggtcatcgggaggcgtcgtgctttttttcatgggaaagaaaacttgacccagagtggcttcattaaagaagggagagggacttcataagtgaccagtcgagagctaggccataggggctgcagacccgggactcaaacgatgtgcaaaggcctcagtttctctcttggtctctcccacaatgctgtctgctcacacaggctttccccctttgcactgttgctggttgcattctcgctctttcccccataaggctattaaagttgctgctggaaggttccagagctgtatgatcccggaattgtaccctgtgaaaaagcatagctgcttttctcacagagtaaagaggtccagccctgagttattttgcccctaatgggtttccagggtcgtgtcctttcccaacccctgaggaagctcagcagagatgcttcaggatgagattaggctcactgagcgggtgaacggagctgtttgaactgaggtctcagggagaccagccctctaactgcagcgagctggatttcagacccttcctgtgcacacacactgttgcttgcccagacatgcttcccctttgtcttgttagaccattgatttcctttagaagatcaaaatcagggtgcaggtaggagccttagacaatttctagtttgactctcatcatatttttaatatagccctgcattttcctcatatgaaagcagaaacccacagagtttatgatgtgctcagagccacgcacaggatcgctagaagccggggccacagcccagcttccaccctcctgatggggaccatatccatgtgctgctcttacatgtactgaaaactcagcacatgcctactaaatgctctgtaggctttatctcattttaacttcacttactcatgtaatctcagcactattatcatctgcatgtcacagaggagggagctgagatgcagagtatgtttgtgacttgcccagagttacacactgatatggtttagctgtgtccccacccaaatctcatcttgaattgtagctcccattatccctacatgttgtaggagggacctggtaggaggtaactgaatcatgggggcaggtttttcccatgctgttctcgtgagagtaaatgagtcttacaagatctgatggttttataaagggcagttcccctccacacattctcctgcctgctgccatgtaagatgtgactttgctcctcatttgccttcagccatgatgatgaggcctccccagccatgtggaactgtgactccattaaacctcctttccttgtaaattacccggtctcaggtatatctttattagcagggtgagaacagactaatacgcacataccatcgattggcacagcataggcactccatgttcatgactccaaagggtaccatctaccacctgttaactgcctactagtatcttcaaatcaacgtaagcctcgtagcgttacctattgctgccttgtcctaagcaatcatgttaatggtatctaggttggatgagctacttatatcttttcaattatacaggaaaaacaatggaaaattgtgataatgaaaagaatgtttgctcacaaaccactgaagatggcttcacctgccaccagtgatatgtgaacacacttatgaaactctcacctatattacacagccagggaggctagtgtatttgtggctgatgagggatcaataagcttatagcataacaatacaggtaaaaatttgtgaaagagccctggtcaccttcagggatggaattgacagcagaaagcccacagcaccaaggttaagtactttgttttgtgtgtatttatgtgcagaaacatagatgtgtatatgtgtagatatacaaccacattatacgttatacttagaagtgcgggttgcatacgccactgcacattagaatcactatacagaatccagcaaatcagattctctgatggtggggcctcaacatcagtacttttttaaaaagtcccaggtgatgtctaagtggagccaggtttgcaaaccaggtacctaggatagaggttttcaactcttggtgtgctcacagagaagcacttgaagtatctgcacagctttgtcaaaatgcagattcaaagcctcaaagattctgatgcaggtaatctggggtggcccaggaatccgcacatttcacaagcacgttgaatgattctgatgcaagtgaagggtctgaggaccacgccttgaaagctctgcacagaccccagctcctctagaggacttgcattgccatctggtgaggactgaagacccacattagctaattacatcagtatttttaactctgggaaaatgtaaaaagaatttagcacccagtgtaaatatggaaagattctttcttaaatgttcagtagaggaccctgagcatatggtgactatatagtcagtagcgactgatcactttttaatgtcagtttcatcgtaatcatacggcttccgaatgccacacattaaaatgttaggtccttttcttcccaacccaggattaaaattcatctcaaaggcaaaacatactgtgatttctcaaatgtttttggaactgtcaaaaccagaggatatatttagaggcctttaatgtagaacacaaaatttcactacacgcagaattgccaattaggatgggaggctcagaaatgatcttaatgacacaagtgtgcagtgtttttttccttctgcattacatgaataatttcaagggtgttttcactctgaatgagttttttttcctccatttggcactgcctgtggagtcctctctatagcagaggtgatgttacgagctgtaacgacgtccccgtcagcaagtagcacatgcttttccattagttatacttccataccttcgtttgcagttttgtttttacatacaggattgaaacaaataccagatagtacttttccaaattgttttggtggactcctccccatccacagcggcagacaactcacattaaatatgaagctttcaccacatacaatcagaggcctatcaaaatagcttcaaacttcaaattaatgccattttaggatcactgatgcttttctttagaatgccatacacttgaaatcttctaagactacaagaactgtatggacatttatagctgaaaagaaaacctatttttagaactcagagctgaaaccctacctcaatactacccctatgttttcaagagttcctgtttcccaatgctagtcaactctgaacctgaattttaaaaattatttcctctctgtttcctccctatctgagaagtcatttatttgatggttttagcttctactggcaactacgacatgatttggaagcctgctaagaatgagtctataatatgtttatgtcatgtattaaaaatctccacggtcttataacttaatataaccctatgtgtaattagttgaccgagagtccttttcaacattgattttgatatatgatttctaatttatttgtttatttacttatttatttttgagacagaatctcactctgtcgcccaggctagagggcagtggtgcaatctcagctcactgcaacctccgcctcctgggttcaagcgattctcctgcctcagcctcccaagtagctgggattacaggctcatgccaccacacccagctaatttttgtatttttagtagagacggtttcgccatgttggccaggctggtcttgaacccctgacctcaggtgatccgcccaccttggcctcccaaagtgctaagattagaggcatgagctaccgcaccaggcctctaatttttaaggttttaattctaggccgtaattttttctcttccaacatgataaaaagggtcttcccatgcccttctcttggtttctcttccctcctcatgcctaccgtttatctgtttccatgacctccctgcccacctcaagtcaggtggcacttcaacctgctggcaaacagtgccacccaacactggcacatgagtccatagaatgtctgggaaaagaggcttgtcgtaccatgtgatgtaaagtactaactgtgcaaacgtgcggcactcaacaattttaggagctttgtgattccttcttaatgatgtgcttaatatatttcccccaatgattgcttattttctctggttttaccctcctttatcaggtccttattgaatttcttcttttcctagttaaactggaaaagtaacttattactctgccaggcagtaggatcactcaccaagagacggtaatgagggagaccacatagcccagttggtctggtgatgcctgttttcccaacatagttattaatagcaccactttcactttgccactttggatggcaaatgatatagcgacaatggcactacatttgctactggcagctcaagaagatgttacagaggctggttttgacggaatcacatatgccagatatgtggcatatgtggaaatagatgggaattatgctggaaataggtggaggcccaattgaccctgcttgctcctgtttacctgtagcctctgcttttctgcttcagcctggaattgtcacagaatatcccagacctcctagtctgtacagggtctggttggacaagacccactggctttttagaattactccggaagtcctggcttgctgatcagaagacttgattcttccagaaagaggtagccaaggagacagaaaacaagctggaatcagagcaagaaagactatgtctaccaaacatccccgtctcttcctactctaactgtagatacacgtggataccatagcagcatgaatgagaccaacaccatcgaatgaccattaaatgaatggtcattcgtttatggggaagcagtactgcagggattatgaggtcttatggtttaaagtacagcacacatggaccacggtcccagccagggcagcctgctgtgggaatctctctcagcagatttttgcctgttagattccagaaccttctctggtcactttcatccaatctaattgtctgtcttacccaagaagggatttgttacaagggacttggtggattaagctaaagcaatcttaaatgcagaatgccaggtttctgatacagataatcaatttcagttgctgcagaaaactctgttgggggtgatggagagaatgcactttgtggacccgtctggattgtctcctagtcttgtatccaggtggcactgagcctcatcagtggggtccactctgttatttcctggcctttacttggtgagataaacccttcatgttcagcagccttgtaacagtttgcagaaaagtctccagcctttgcttatgtgttgggtgcaagtctactgatacatcctgagggtgtatgctgttgccggtgcgttgcactaaatgcctgctactgaaaatatgcccagggaatatttctctttatatctgtggaactttgtccatcgctgtgctggaaacaaactattccctgggcagtcagtggtgcgcttttaattctggcctgtgtggtggcagtgggaggggcggtgccttttgctgcgtcgggaacctcttgatcccaccagggtgagctgaaagaccttgaatatgatacttcaaataataaaaatgtatgtgtcaccttggatctgcccagaaaaggggagaggattttacaaacacacacacacgcacacacgcaacacgcacacacacacgcacgcacacgcgcacacacacgctgacacacacgcacgtacacgcgcacacatgcgtgcacacacgcgcacacacgcgcacacacacgcacacacacacgcacatgcacacacagagtcattcaggaaaaacaacaacagaaaacaatttagcacatttttggtgctctgaaaatataaattgggattttatctaccaatattaccatttatcaagttataactatgtatagcatttaattgatataaatacacacagcataaacttaccccaaagtatttatgctttaaaaatttatttacaaataatctgggagaaaaaggtttatttcaaaactatatagagggctgggcatggtataatcccagcactttcggaggccaaggcaggtggatcacttgaggtgaggaattcgagaccagcctggccgacatggtgaaaccccatctctactaaaaatacaaaaattaggccgggtgtagtggctcacgccagtaatcccagcatttggagaggccaaggcgggtggatcatgagatcaggagttcaagaccagcctggccaaaatggtgaaaccctgtctctactaaaaatacaaaaatcagccagacgtggtggcgggtgcctataaatccagctacttgggaggctgaggcagagaattgcttgaacccgggaggcagaggttgcagtgagccaagatcacgtcactgcactccagccagggcgacagagtgagactccatcttaaaaaaaaaaaaaaaatcagcttggtgtggtggtaggtgcctataatcccagctactcagaaggctgaggcaggaaaatcacttgtacccaggagacagagattgcgccgctgccttccaacctgggcaacaagagtgaaactctgtctcaacaaacaaacaaacaaacaaaaaatatatgcagagaagagagtacttaggagcacagtgggagggtgagatgtcagggctcagcatctgcttccgaagttgtcaccaggcatttgttcagggcatgtgggcactaagaggatgaccccgtggtggtcaggtaccttgctgctctgcacacaaacaatagaaagcaatggagcccttgttagaaacacatatttctaagctccaagcctggagcctaggaaacagtgtctcccaggaagaaacctgttaatctgcaccatgtcagggaccccaccccaggattcttaccagtagtgatgggtgagaaacactggctatgctaacagaagcaggcacacagcggccccgtcttcctcccatctgtgagcatgcttcagggctgagcatatgaccaacattttacatttcagagttggctcccaccttaacacacacaacaatgtggacaccaccataaactgtgacatcaccatcacccggacaccagtgggatttatgttgtgtggattaatggccagtggataaatatacagcaataccaaggggcaggtcaacagcttaaagattaggagaaaacaatgagtcagaaactgagcaggtaatcatcagagcatccgtgaataatctgacagactcctcagtcttccacatgtgcacgtggggcagaatgttgacatccaagtgggcatggtaagcagctgatgaaaagttaaggatggaaactttaggcttgaaagtcagcaaagtgaagctgacttgccaagaataaactaagcagctatgtggcatcatgcagatacacacacagacacttttttttttttaagatagaaggagaaacagcaggagagggaagaagtggaaagaaagatgctgacttgactggactcttcactgctaacctttggtgaaggataagtttagacacaggctgcctacatgcaagcatagagatatttctagtgtgccttcttataaaggaagcacaggtagatgtttgtctttgtatggttgtaattaagcgccaaatgatgtcctccattcccttagtgacctaggaagagaaccagctgtgcagcaccatctctttgtctgtttttggaagtgagcccaatgcacttgaccctcagtgctatgagggaccagggggctgacaggtgaaatacagcagggaaggctgcaaagaagccccaagctgctgcgggcagggtgtgtgcaaggcgcacggtacagacagacccaccctgtgtttgtggggcaagccccctgtgcctttccccctctgttgcctctttcagctgccctcagtccttcccacaattcatcccatctcccagcacctgttttggatttggagccagtatatgcaggagagaaaaagaagacagtaaatcgagcaagaaaaaggaaaatgttgtattctggagcagaattacgaatgagtcagcagcaaggtctgacaaaacaaaatacaaaggcagtaaagtaggaggttggctgccaggctggtgtgaagctcggatacctgtttctcagtggccgccagtagaagacagggatatgacaagcttgggaagaaagcaggcatgctggtgtgcatcctggaaaattagttaggaggaaattctcatgggtttcttcctttgaatttcctcctagcaatgctatggctgatttcatttgtttcccagaagatgagctgaagacacataggagcagctattggaattgaaatgtccaagtggagactgaaggaaatatatattttgtaattactcagctatttctggatgtcacagatgtttttgaaacgcatatttggaaacacagttgaaatcacaagtgaaatttttattgttcatctcctaaatgtaagctttttattttatttagaggcatcctcggttttaatcatcttgttatacttagatgttctcctcttaacgactcattgcaaaaagaaggcattctatgtgaagggtacagagaatgcgagaaacattctctatcaatgacctgaacaactagggattgatcagaaaagaaggaactaaggtataatagcgttgggtgtggtatggaagtagaagtcgtttgagatacatatttgaagaagctacaggttcaagaagaactcaccatttctactctcttaaatgtaagttttgtgaaagaccagtgactactataagttagtttattccaggaggagagaaagagctgagatataaatactgaatcctaaggatttgtccattatttttgtgtttggaatctgacaactgtatgtcttctatattttaacccttgtataaatggttgcagtaaattgcctagagcagtgaaggaaagatgtgcagccaagggaaagatcaagaaccttcggtttacatggagctatttcctaatatttgttttatgtcatatgagctaaacatctttaccttttactaaatatttcaaattttatctggggtccattagaaattttttctttttttttttttttttttttttttttttttgagacagagtctcactctgtcaccaggctggagttcagtggctcaatcttggctcactgcaagctccgcctcccaggttcaagctattttcctgcctcagcctcccaaatagctggaactacaggcacccaccaccacgcctggctaattttttttccttttttttttttttttttttgagatggagtctcgctcgctctgtcgcccaagctggagtgcagtggcgcgatctcggcttactgcaagctctgcctcccgggttttcgccattatcctgccttagcctcccaagtagctgggactacaggcccctgccaccatgtccagctaatttttttttgtatttttagtagagacggggtttcaccatgttggccaggctggtctcgatctcttgacctcgtgatccacctgcctcggcctcccaaagtgctgggattacagacgtgagccaccacgcccggccttttttccttttaagtcattataacaagacgtttaacttcatgcaaatggtataaaatatattggcaaggagtgcagaaatgtttgccaaatatggtcattaatatgggggtgactacgacctgcttgagagaagagaagggaagacttctctagggaggactgattcattcaggaagttttccatcatccttcaacttccgcatcaggacttacagttcactggaccatcagccacaggagtgggcccagacaccagacaagaagtcagaagttttggcaagatgccgggtctttgggtgagtgcccagtgagaggtacaaatgcaacaggagtctgacgccatggagggatgtgacttctgcagaatcttgggaagggggcagtgtgggttttgcatgtgggagggacttaaataacttttatcacagccaaatgtgacatgctaaggcctgaatgcatttattcatggttcaggcagctgtagccaacaacaagaagcagttaaagttatgtacccactgagagcagatagcggggaggcagaggtcagcacctgcttgcctgggagctgcagggtttctgagcgggaaggaatgttagtggttgctggttccatctcaccaattcctgcattcctgcattctgaatgcaccaacaaatggcttccatccttctattaacaggggctgttgagccttttcagtgttgaagtatttcagactaccaaaagacagtttcatggttctgaaatctatttccttctaatgtgtacttgtcagccttattcttcccatggaagcaaaagagaccaggcctactgacatgcatgtactcatgaagttctctaaaaccttaaagacatctatccctctcccccgggtcgtctcttgtctgtgcagaatacttccacttgctccaagcatctctcaggtagctttgtttccagactcagccaacctggtcatcttctctggagtattttggcttattggtctcaccactagaaaaaagtgacaccctcaactggacctgttacttcaaatgttaagggagaaggttttagacaagataggacaacatgtcttcccagaaagaccttatgagctgggtagctcttgtctccgcccacattattagagatgagctcgtttattttaactatccaaagaaggatctgggtggaaaatggggaaagtctgcttctgcctcccctgccctgaatgcccacctgataattagcccttccacaaagcgagtccccaggggcttcctggaagcacagcagctgctacatcgtgcaggaccatgacagtggatggaattaattactaaaaccagccaagaccaagattaaggaagataccatgtaaatgtggcaattcgcgaagtatttctgaaaaatgaggcatctgtttcctggtctcacctctcctcatgtcaggtgaaaggtgtggcggggaatgggggctgtaattcagacttaactgtttgattgatcttctcggactcctcaaggttatcagagtaaaaaaaggaatatgtacaggacattgctttcatgaagtgtctgtcacagtccacaaaacctcggcttggattgtgaaagcagattgttttctgtctcctaggggactgtctattgtgttaatttccagatatggatatgactgtgccatctagcacctaacggaacttcttttttatctgttaatgatggaacacttcaaaattgcaagaaaataaaccctttgagtaaacacttcattttctcattttcctcagttttagagccaagaaatagaatattttccagcttctttttggtgcttttatttttttccttcaggttttactttttttcccttctcacccctgacatctcatgcagataactttccttttttttctcttttttaccacccagtctctaaatctcactttcttttctctgtctcatctgccttttctctgtgttaacttttccagtattttcagccttgcttctcattatgttactatattgtgtttctttaactgtgtatgccagccatggggttcttgattctagcttaagaaaatctgactctgggctcatctacacctcctgttatttttcacttcctctttgaatggaattgtaggattaaataaggaaaggactgtggaggtcccctgaagcaattttcctgcaatgcatgcacccattccagaggactccagtggtgcttcgagcccctgctcatatgctatccatgctggggagctcaccacctcagggagaccatccatcctcatacatgctctaagtggactgcactaatgctgaccagacacccagtccaaaatcctgggtaacaatctcagtcattgaaggcagctgcaactctgccattcttaatgggattccggtttgccaagagccccagagagtagaaaagtaagagtttcgtggactctacacaatgctggtaactagatcatgcaattctcagaatttagaaaagagtgttttttattcctttcttgtgatttgaatttcctcacaacccttagccctgtattacacaaaaggaaactgaggctcagataagcaacttgtgcaagttcacccagcaagtgaataacaggctcagatgacctctgcgccttactctaaaactgcctaatagtagtagctgtgtcctactccagagctacacctagccaccctcttctgctggcctcagcctggtgcattgttaggaagggaatatctgaggtgatgtggaggagggaggggagcacaggcaggccagacaggggcaactttggctactccagcatcccaaactagggccgtgctagagggtagaaaacgtggtgtaaatttaaggggcattctcaagttacaaagtcaagtgaaacttggtaatcatgtttacatggacagtaaggaaaataagcaaggggaatggctgatgcgaattccaatatttttctgtggaaagaccaggtacatggaaggaaacagagaattctttagcagaaaaagaatgtatctctctaatgcccagtgatgatgagctttttttcatgtttgttggctgcataaatgtctatgcagccataaaacaaatgagttcatgtcctttgcagggacatggatgaagctggaagccatcattctcagcaaactaacacaagaacagaaaaccaaacaccacatgttctcattcataagtgggagttgaacaataagaacacatggacaccgggaggggaacatcacacactggggcctgtcgggggatgggaggcaaggggagggagagcattaggacaaatccctaatgcatgcagggcttaaaacctagatgacagattgatgggtacagcaaaccagcatggcacatgtatacctatgtaacaaacctgcacattctgtacatgtcccagaacttaaagtaaaatttaaaaataaaataataaaaaatttcacctaaaaaaaagaatgtatttcattttcaaaatattgaatttggggttaaagtttggcataaaaacatccatgtggaaaggtccagcccaagctaaaaatataagtttagaactcagaagatacatgaagcataaagacgtaaattcagtaggaagctgtgtcagaaagcagaaatgatggggacctgccagaccaaggcttagaccagtgaggaaggagcccctgggatggcaggttggtgcctgccttccattcgggtctgcagcagcaggagagaaaggtgaagagcctggatggaggggcaggaggcgaaggagagcaggtcctggaatcaggaaaggggaacagctcctgttgccttcatcacgtgctgcaggctggaaatcagaaagatgccacgtgtttggtagataagggttagctgggagaactcattttgagaatgctaggagtatattgcagtgggttaaaagtgaatagaaagtgagccagtgaagcagtgtagactttgcttgtgaagggccatgatagttacaagaaggaggctgggtgcagtgtctcatgcctgtaatccaagcatttgggaggccgaggcaggagaatcacttgagcatgggaggcagtggttgcggtgagccaagattgcaccactgcactccagcctgggcaacagaacgagactctgtctcaagaaaaaaaaaaaaaggaaggagcagttccaagggaatatggccagaggttttttgtttgttttgtttgtttgtttgttttcaatgagggagatttgagttatattctacagaattagaagaagtaataggggagaatgagtggttagaaatgtaaggcacagtggagaagttgttaaagttcaacaagaagcaggagggtatgagcttagtcttgcaaaggaagatggcagtttcaaaacgtcagccggattcaatttaaagcttaattaagcagtgaacaatttgcaaattgggcagcctcctgagccacaataggctctgagactccagtgcagccccatggtggtagaagatttatggacagaaaaaggaaagtgatgtacagaaaacagaagtgagggacagaaacagctggattcgttacagctcagcattcaccttatttgaacatgcttcaaacaattggctacgtttgattagccaaaacttggtgattggcgcaagagtaggttatggtctgtttacacctccactggttataattcacaatgtgcagagaaacctttaggctgaacttaaaacatgtaaggaggcagctttaggctaaacgtgacttaacggtagcttctttgtaggagaggaaggatggaggagaggcctgacttagggcacttgacctaggaaggaagagtagaagatggatttgagaaagacttagaaagttactgattagaaattgggcgctatttgattgaattggagtaggggaagcaaggggtcaaagaatggagggaaggaaaactacattttcaactcagcttactgagtgcatgatggagctaccaactgagatagggattatcaaaagggagcaaggtttgggggctgctgaagagtttattctggagcaaattgagtttttggtgcctgtgagacataggatgcagtcatctgatatattggtctgtagctggacctgtgggagttactgatatttaggtaatttaggttacggtttaaaatctcaagaatggaagatttcataggggaggaggatgtaaagggagtagatgagtggccaaagaaaaaactcagtgtccacgatggtacagagaaagaaaagaccttagaaatctaaagtatgggtccatcggagagaaggaggggagagggtagaaatttcctgactagagggaaattttagagagataagaagcagaccaaatatgaactcaccctgtgacaaatcctcaactgctttctaaaaaattattgaatgccaatgtcaactattttgtgtgtaatatattaaaaaaataatttgctgaaactgtttttccatcttgtggatagtgttttgggaaataagttctcctttattcattttccaggagagatattaatgtaatgctataggatgagactaaaataactcatattcatgaacttctaaaaaatggcactcttagaaaaataactgaaagcagccttactaatttccaatctttgtattttttatgatcagaaatatttagtctattttattttttatttttatttttatttatttattcatttagtttttgagatgaagtctcgctctgtggcccaggctgaagtgcaagggcatgacctcagttcactgcaacctccgcctcctgggttcaagtgattcttccacctcagcctccggagtagctgcgattacaggcacccgccatcctgcctggctaatttttgtatttttgtagagatggagtttcaccatgttgactaggctggtcttgaactcctgacctcaggtgatccacccgcctcagcctcccaaagtgctgggattacaggcgtgagccaccactcctggcctagagtctattattttaaagaaagaaacataaatacaacattgaccacagaaaaagaaaaagactttatctctctaaggaacaaattctttcagtgagatgcagctttcttagtgcctttctagataaaacattgtacaaatgaaaacgcttcaatttgcactctttaaacagtcattccctttgtgcctgcagttcttttggcttgatgttgaggaagattttgtggaagacaatgatattttattgcttcatcttggagcaaggagaaaattgtttctcttcttcccacttccccattttttaagagtagtgctcgagtcacacttgcacttccacgctgaagccttctatttgtatcaacagtgtgttctggaatgccactttcacattcccacacttggcagacccagcttctcaggttttctctatttcttgactttattcatttttgtttcagcctttcttttttttttcttttttttttttaattatactttaagttttagggtacatgtgcacaacatgcaggtttatatcatatgtatacatgtgccatgttggtgtgctgcacccattaacttgtcatttacattaggtatatctcctaatgctatccctcccccctccccccaccccacaacagtccctggtgtgtgattttccccttcctgagtccatgtgttctcattgttcaattcccacctatgagtcagaacatgcggtgtttggttttttgtccttgcgctagtttgctgagaatgatggtttccaccttcatccatgtccctacaaaggacatgaactcatcattttttatggctgcatagtattccatggtgtatatgtgccacattttcttaatccagtctatcattgttggatatttgggttggttcctacccaaaggattataaatcatgctgctacaaagacacatgcacatgtatgtttcagcctttcttataggcgattccattttccagatattctattctagtccccatgcatacattttggttttgatttggtttggtttgggggtttcttgcctaacggtacagacgaacaattaaaagcagttctctcctcctcctcctcctcttcttcctcctcctcctcctcttcctcctcttccccttctccttctccttcgtctccttcttctccttcttcttccttcttctctttcttcttgccatggccttgatagggttattttaattgctctccccgtttcttatgagcaccacttaaaagatatccacagagctgaattgcaggggtgtgtagtggtatattcaaagatgaatgtaaagatgtaactctaggtgtttgttttggggatggcataaccagggaatgaatttaaatcactgtttctagatggattaaagcaatggaccttcaaccaggaaagatggcagctattcttactttgcatatttattatatttgttgctatactgaaattttcagctgacaacagcgaacacggacttctgacttgagagttacgagatacaagcttggttcaggcaatttccaagggattgtttagagagagacagaactcaggtcaaatcccacttgactttaacttaaattccttaagattttattttcctacctgtacaaataggacaataatatctgcctcataaagactaaatgagttcttgcatggtaaggagctgtcagagtacctaatatgtggtacgtgctccataaatgccacccacccccaccacccacttcagctcaccactgtcaccatctctgggacttggcttggctgaagtaatatcaaaggcttcctctgagtgcttcagtctgtgagtggtcctctcccagcccctcaccacctctgtcctgatactattttaacaaggaatttatctgtttgctttagaagttgctggaagtttacaaagaagaaacccagtagttcagaagaaacgtatctaaatctgattttaaaattatctgttttctctggatttaaactagctatattacttacctattgctgtataagaaattaccccaaactcagtggcttaagacagccaacatttaatcttgcagtcactgtgggtcaggaactcgagaacatcttagctgtgtggctctggctcagggtccctcatgaggccagcatcaagacattagccagggttgcagtcatccgaaggcttgaccggagatggggaacccatttccacatccactcacatggcttctggcaagaggcagtctaacgggtatgagcctcagactctccatggggctgcttgagtgtcctcacaacatggcagccagcttcctcagagcaagtgatatgaaagacagcaagaaggaagccacgatacctcttataagctggctgcagaagcctaacaccctcactgctactgtattctgttcatgagggtcactaagtcagccaacactaaagggtacagaattaggttccatctcttctcttctctctcctcctctcctcttccccctttctctttcctttatcctcttcttctctttctgtgcctcagtttcttacctgaccaaaggtaacttctgccccctagggatgctatgaaaacaaagtgagatcaatcatatgaaaaggcggttttggagggagagttcagaaactctatataatataccatataccataaccatggaaacctgagatcagctctgtctagcttcctgctcttgcatctgaagaagccgttccagctcacacaggcatggcttagtcacagtgcagcatggggtcctttaatgggtcctctctgagcggtgacctgctcaggacacaggagccagcaccaggcccttccttccttctcctgggcaagcagcaccactcatcccggcagaaatagaaaaaggagttaagttcctgtgttccttattagattgctgtagcagctccataaagctctcctagacagtcctgtctgttagtggctgtttctttatgactaaagcagcactttcccatctgctgccctcaaagcaaggggccccgggccgcatatttctggttcaggagtctcaagatctctgaaagcaccagattgttgggatttaagtgctgttgtttatttttatatctgggtcctgttcctccaaataactccaagaccattgtgattttcgagaagttaattcagtggtgcaggctaggtagggaatggtggtattagcaaatcctacctgttttctttgcaagctcatttccatcattggtcctccaaatgcatttccctgttcaaagtactctaccttggatatgtctgcctttgcctccacgtccctcacctattatctttagaaaggtggttttaaatgttggtcactgaacatttagccacatagggcaccagctctcagaggtttcacaagtaaaggaaagggttgggggaaatgaaatatggttcaacgcaacagagtaacccacatattccgtatgttcgacaaggtctctacccaggaggctggcgatgaaggatgctaacatttcttgaaccgccatcttctcccttcttttgggtaaccctcgaattctgcttatggttatctatggattgtggagtcatttcctggctcaggaggttaagaaaggcgtccgagatttgagggttacaggagtttggaagcactgtttttctggttttctgttacctccattttaaagccgtgatacttccaactgcccttttttcagtaagttcttgttgactactctcttgaaaccaaaagatgcatatcccgttgtacagggggtcaaaagtgtgcccaattaagcctgccttgacttcaatattgcaactcactgaagacacacagtggaatttctggtggaccccttcccataacccacagggaactctagccgtacatgggtcttactgacccgttgggtctagctgacggtgcctgatggtctccaatgaccaaggtgtcctcattagttctgtgctatatttagttaagcctgaaatctgtgcccctaatttaatcacacaccaggtagccatggagatgacatcaagcctctggctgccctataaaccattgcaaatgctgaaaataaaataaacaggatatgcaaattgacttcctaagtaaataaaagactttgtctccaggtgttgggattagctgcttttggttcactgatgtttgttaggattcacagtgatttgaaaaatatcatcgtaacagcctttgtctcaatgcctaccttttttcctttttgtctgttgcagatatatcaacactcgtatactggatattacgtcctgagcaaaattcctcatgggtaagagtgttcttttctttcttttaattagaaatatgcagggcaaagtgaagggtagaacatggacgagctgtttaacccttagggcgggaaatggcgttccagttctcacagccaagggtgctggtatcgtggcacctctgggactctccctagataatgacactaaggatgtcagggggtcacttgagtccactcacttccccatttgtgaagcccccttcctagagcaactctgccctcttcctgtgctggttcctgcagttgaccctggaggttcttcagagccggacattcccctctgctttgtaatcacctgcagcctcctctcaggcaaggtgaggtggcccttggcctcccacgagggttcctggttatacccacactagcagaatagaagcctctctcagcccaccacatgtcatcagagacaaatctggaacatatctatgggattacggtaaactactctggtcagacattcagcagtgcattgggaatgggttgggcaagtggtattagtgctgctctacccatcactccgagggggtttcagcggcgtgttgttcttgttttattgtcctttctgagcttggctgtgctcccagggccgggtttcagtgcctgcttttgactgggccccccggcttcattctttcatgacctcacattgcactgctaacctcatctggtctctcaataatgtattgtccagagcaggagcgagtttagttttcagtgctgggcaggcgtcccccacacgaccctcagatgcctgatcagcttcacctttggaacccagagcagaaaagacattggttagggtttggtgaaaccacatgttgagtcagacacagatgaaaaatggttgcagaactaggaaagtctgtcgaggagaattttttgttgttttatcttcattatttcttcgtctcctcttccctcctccttccctcccctattctcattcccttctcctggccttcctgttccccacctcatgtttctctttcctgtcttctgtggtttctactgtcatgctttgcaaaggtgaggtgctcaggaaaggttgataaagaaactgaattgtgctgcagatagtgtcatgtaggctcctgtgaatatctaggttgaggcatcctcatttcccaagcaaattttaacagcaggagtggctagaaagcatttttccataggtgagcattaatcacagcatgagcgtttatagctgctgctctctgttttctactcagcttagaatacaggcaagtccttggaaaacaaactcgaataaactaatttaatgtgggctttagacaaagggaagacgcatgtggatcttcagcaaattgtgaccaatagtttctgttagattattagaaaagtgaagcccaaagaaagcaaagatggcccaagttgcaaaaataaagtattcatacaaatttttcattaaaagtatgttttaaatagaaacccaaatattcttcagtaaagaggaattatcccattctttcccaagcagatatatatcttcagaggtcatggcaggcaggactataattatgccttgagatttatctgccccttctgggaacaatagaatttgttgtagatgatagatatttcgttccatcttatatcaatttgtaaaactcgaaactctaaaagcagttgatgcctaacgtattgtgttaatattttactgcatcagtcagcatttggaggaaacagattctaggaacttggcacaggagtttgctgaacaagctagcaaagctcaggccatgatagtctgtgttgaaggctcggcttctgcacttagatacctggagcctggtgatgatctgccttatagatgaccccaacacggagggagctgcttctggtgtctttaatggaatcagagcaagaataatgcccctggtttattggttagctttcatatacctttatccctgttcaacaacctgcaagaaaagcatccttatttccattttaagtgagagctccaagaggtcatcaccttcccctcacctcctagctactgtatgcttgagtctcagcgtaagtcaggctgactcgaaatcccatgctagtaaaaaaactcgtggctcacacctgtaatcccaacactccgggaggccaaggtgggcagatcacttgaggtcaggagtttgagaccagcctagccaacatggtgaaaccccatctctactaaaaatacaaaaattagccaggcatggtggtgcacacctctagtcccagctactcaggaggctgaggcaggagaatcgcttgaacctgggaggctagaggttgcagtgagctgagattgcaccactgcactccagcctaggtgacagagtgagactctgtcaaacaaaaacaaaaacaacaattgggattaattcaaaggtcacaatgcagagaacaaacgtgatagctataaagatgagattttttagtgacatactactttctcttcctagggttcttataggattgaaagatgtagcaagtacatttattggaaaacaacctctgggggtgccaaagtcagtgtcccaccctgtcaccatgtcactgaacacagcgcccctgaagcggcgttgctcaacctgctcaattcttcctctttgtcataaggccattgatgagaaattagccaattaattcattgcaaatattgtcagagtcttatttgtcttaatgagacagtggatctctgagcggtatctccgtaggcctggagcttcgtgaccccttggtcatcactgtcaccggtgtgcgtgctccaccaggtggcagaaaaagaacacagcccggagctctaagtctgaggatctaggtgggttttggatagggaggaaagcacaattgtcttttaaaaataaaaatgtccctactaaaatatttgaatatacattattcatgtagaagaaaactaagagattttcttaatttagaaaacacatatctgtacctttttcactaattctcatctttcctttcctcgctcctccctctaaattaaagccagaggccgtgcaatcttcaggatggttttgtcatttatagcttgatttttttttcttagcttcagtctttgcaaccagccagagaaaatggtctaattaatgttctcatgccctctgatttctgttgtccttccttttggcaaatggcaaaagagtttcaggacggactacccctttcccatccccctctcactccccagtccccgctgttagcttccttcctccgatggctgtgacctctatagctggggccaggtagagttctttctgtgtggaaggtgggagttgcaatgagactcccaagacagctgaattttgatataatcaaaaatctattacctaagggtaggtttgtttgactttgacataccaagcttccaaaaattgtattcttaaattgtatcctaaaaggacatatgccttttacaacaaatctatattttagcggaactaaagctagttatttttaacataaagcatttcactagaagtttttatatcagaattttaataaaataaggaatcttccatggtggagtcaaggatctgttaggtgtttccatataagtatttttgtagacttggctactgcatgacattttcctggcatgacttctttttctagaattagttttgtctttatattttttagggtctaaagccaaaggcaaaattatctatatttatgtctattatctatctacctagctttctatctatctatacacacacatatacataatacacacttttaataatagtaataatatatttctaaaatgtagtctcatatccaataggattgttctgaaagacatatggacttttttctataaccgaaatcaatttgaagaaaaattggtcctatcactttattatgtaatgttggcaattaggggtctggcaaactcagaactgtaatagaatagaaactgctgggtgttcaaaggcatttttttacgtgactggccatgttctgtggatattgttgctctaactttgcttacctactcgtaattttcaggcaccaaacaaaactgtgaaaaaattgtgttcctttagaattgtagttgactttttaaagccatattctgtatctgtggaaataggaaactgagacatcacttccttctacctggaactgctctctaagtttatagactgagatccagaggagcattctgtttatttgggaagtagatatctaggtcgagaatgtacagtgcccagtgccagcctaatagcatcatgccaggcagtgacttagaccctgcagccacatagacctgaacttgaacccatcgtgctgctgacttctggttgtgtgaccttgagagttgttctacttccataggtcttaggatccatataagaagatcataataatagtgcccactttggcctggcatggtggctcatgcctgtaatcccagcactttgggaggccgaagcaggtggatcacctgaggtcaggagtttgagaccagcctggcctgttgcaaaaccccatctctactaaaaatacaaaattagctgggcatggtggcgggtacctgtaatcccagctactcaggaggctgaggcaggagaatcgtttgaacccaagaggcggaggttgcagtgagctgagattgtaccattgcactccagcctgggagacaaagcaagactccatctcaaaaaacaaaacaaaacaaaaaaattagtgcccacctcataggcttgttagaagaattaaatggaatggctgggtgtggtggctcacgcctgtaatcccagcactgtgggaggctgatgtgggtggatcacttgagttcgagaccagcctggccaacatggtgaaaccccatgtctactaaaaatacaaaacttggccgggcttagtgaggctgaggcacaagaatcacttaaacctgggagtcggaggttgcagtgagctgagattgtgccactgcactccagcctgggtgggagagcgagactccatctcaaaaaaagaattaagtggaatgatatatgcaaaacacccagcaaagaattttgcatctagtgagtgattagttaatattgtagtatgtacccaatatatatttgtagtcttataattaaatattatcagactttagtttctagccatcttgaaaatcttttctgttacaaatgaaggaataatataatcctaaaatcatacaattctctttaataatttttctaagctgaggcttgtttcatgacactcaggtaattataatgtctttgtaattttaatttccctcttaaaagaagtatctatggcctcaactgtctacaattctcaatactcaataattttttttatatcatctcattctgaccttctgcaattaactttccagcattcttgttttgcctccaatggaagcagaaaagatactgtgtcagcaaatacttattgaaatactgtctggagcaatgaaagcatggttgctatccttaagaaattaaaaatcttgttgcaaaggaaagatacagacttatataataaaatgttataaagtctgttaagtgagtaatttctttttttttttttttttttgagacagagtctcactctgttgcccaggctgaagtgcagtgatacgatctcagctcactgcaacctccgccccccaggttcaagcaattctcctgcctcagcctcctgagtagctgggactacaggcacccaccaccactcctggctaattttttgtatttttagtagagacggggtttcaccgtgttagctaggatggtctcgatctcctgacctcgtgatctgcccacctcggcctcccgaagtgctgggattacaggcgtgaagtgaggatttttaacactacccaccaaagaaggaggggagggttgaaggtgtcaccatcataaacagtctcaagaaggaagtttgacttgaagtgagcctgatagctgagtttttgtttgtttgtttctttactttttaatagatgacaggagggagatactccaggcagggtaaaacatgaaatgaacttgacctttgcatgagccaacacttcctagaattaatgaggtgccctgccaggctgctgctggagtgttcacgtgggactcagcatgggtaggcatagggttaggtaggctttaggaggtacctagagtgcagacaactgaaatactcagtgtttaaaacccagtagtattggtctttacaataagaacatagcaaccttttggagcagaagaggaatgtgatgaaaacagtaggcgcagattagttttgtgcttatgtatagcatacactgaagaaaaaggaagatcaaaattctggattcaattagcagccaggttggaatggtgggtcgggagctcagccaatgtagaaaccacactaattgtgattatgagtagctggtgttctcttggaaaatgaagacagatttcaagtgtttatattccatgtccctctaattaaatctgtggcagcctgggctccttgtgagttgagcctggtgccatcctgagaggtctctctaccatgagtggtctgtaggtagtgagttcaggagggcagcgatgagaattctcagcacccatgttggttagtgcattcctttccagccctttcttcctgtgtgtgagtctccagggcctggctgctgcacacacggagataggctttggctgtgcagagcaagctaccttcacagctgccggaagttacagaactaggattgtgtgtgtaaactggggaagcaccagtgtgaagcaaaaatgcagaagaaatcttaaaatggctttttttttttttttttttaagatacagagtctggctctgtcaccaggttgaagtgcagtggcgcgatctcggctcacttcaccctccacctcccaggttcaagcaattcttctaccgcagcctcctgagtaggtgtgactgcaggtgcacaccgccatgcctggctaatttcttttgcattttagtagatacgacgtttcactgtcttgctcagggtagtctcgaactcctgagctcaggcaatccacccgccttggcctcccaataaaatggcattttatgtgtctgtaccatggcattgaagaggggagaattccactgttacttgctttttttgttttgtttatttgttggtttttttttttttttttttgagaggaagtattgctctgtcgcccaggctggagtgcagtggtgtgatctctgctcactgcaagctccgcctcccaggttcacaccattcttctgcctcagcctccggagtagtagctgggactacaggcgcccaccaccacgcccggctaattttttgtatttttagtagagacggggtttcaccgtgttagccaggatggtctcgatctcctgacctcgtgacccgcccgcctcggcctcccaaagtgctgggattacaggcgtgagccactgcgcccggcctgttacttggttttatggattttcagaactgtgaacaactcatacatctgcctgtaagacttggtctcagccatttctccctccccttctcccttcccctcctgtcctccttctatccctccctcctgctgaaatccagacttctagtaaccatcaccaaaaaatgtggactttagagtcaaggagatctgggcgtaaatccccagtcttcgtttctacttgtgtagtcatgaaacagttcctttgctcctctgggcacacttactccatccatatattagttgcctaatgcatggggtttatggtgaagtttctgtgaaacactgtatgatgaggtgatgtctttaagggcctgctttggttcatagaaaatactgagggttgccaggcgcggtggttcacgcctgtaatcccagcactttgggatgccaaggcgggtggatcacaaagtcaggagatcaagaccagcctggctaacacggtgaaaccctgtctctactaaaaatacaaaaaattagccaggcatggtggtgggcacctgtagtcccagctacttgggaggctgaggcaggagaatggcgtgaacccgggaggtggagcttgcagtgagccgagactgtgccactgcactccagctcgggcggcagagtgagactccgtctcaaaaaaaaaaaaaaaaaagaaaatactgagggctctattcatggtggacaccaagaccttccataatatggccaaatctaattagccacccttcatcaaatttccctaaatttgggacagaaaataaatctcatactcactgttaactctgaccaattgacaatgacttcctggagctctacatttaaaaatagactaaaaccatgcccaggctctttaggaaagaatgccacaatcagtgagttttgcctctgaggtttctattctcccatccggctgtgtaagaatgaatcacatcacgcaatgtgtccagtcattgctcccaaacccggaatgtgtttctggttatccacacctctattgacttcattctcctccccaccacacgagccccctcccacacatgcgcactacagaaatgtcctggtcattgtgcctctcatactcaaatccttctgacccttcaagccacagcgtcaaaacctccttctctaaaaaaaacctgaatgctgagagtcaatactgcttcttatttcacgctagaatttatcgttttgttagatggctacttccattgttgtagatagaatttttctaaaggggatatttaggaatgctttccatatccatgtattgcttgacttctttctctccgtcattctaagttgtcagagagaggggttgggtgggaagggtgtggactctgcctgtaataccagtagctgttgcacagggtgacactgtgactttgaattgcaaaagtggcgaaagaggctgcaccaacaggtcttatgctctttccaggtgcaggtctcagataacaagctgaaggtagtcagtgactggaatgtcatcggccacctgcaaagggagtcattgcagctactcttttcagtggaatcatttagttccctcagggactttcttagaaagtctaaaagattttcaaacaaacaagtctctttgaaaatgaggtgaaaatgcccaggagtcctcatttggtcaggctccttgttcatcttaaactctacacccatgtccctggttcctgatactgggggaccccataaatgttggttaatcactggaggaaatgaattaaggaactaagccatgctgaggagcaagaatgtgtgtgctggggccccaccacaaatgggttaaataagagcctctgaagagggaacctcaggatggctttgaaggctacctgggtgattttggtgtccagctggggtcatctggcctgctcgcccctttacttgctgcccttgacaagtgacacccaggattgccgtggaagctgagaaataacacttctgtctgaatatgccagtaaagtttcctctcaggcattaatttccttgtccactcaagaaacttggagaaataagggtagatctcagattaaccatgttcttggggatttacttaatgatattcagtaaaggggttatagtatcaaagtctgcagcatggagatgaagcagagccggctcttccggggtctgtccacatcaaggggcaccagacgttggttgtgattgttcctgagcctggccaacctcacatgtgccctgggctccctctggtgagctccggtcttcaccttaaccgcgcatgtttgcattgcggggaatctgtgcttcagacagacacgccagatgttacaggtcactgcatctaagatggaaggtgttctgtttatttatttatgttttaattttggctgttgatcactttcttgtgctggtgaatcagcacgcgtgttgaaccagccattaatctcctgggagagagctgttgacatcctggagggtggcactcttcctgtttacagatgttaaagagaaaggcccatgggtgtctccctgggtggccaagcctggttcatgtgtgtgctgtgctgtgtgttccttcttccacacaatcactgagcctggccgggcacagtggctcacgcgtgtaatcccagcactttgggggaccgaggcgggcagatcacctgaggtcaggagttcgagaccagcctgaccaacatggtgaaaccccgtctctattaaaattaaaaaaaaaaaaaaaattagccgggcatggtggtgggtgcctgtaatcccagctacctgggaggcagagacaggagaatcgtttgaacccttgaacctgcgaggcagaggttacagtgagccgagattgtgccattgcactctagcctgggcaacaagagcaaaactctgtctaaaaaaaaaaaaaaatcactgagcccctcgcaagtgccaggcctgatgcgaagcactggggatggatagggaaaggccccacctgtcccttgctgtctagtttattttgttttgtttctacgtcacctcctctctcccctgtgctcctgcagagggttggacacaaataccccactgtgtctgcgctggggacattggcctaaatcaaacatctagggcagcctcagccaggaaagggcatcactcaaggagagggagcaggtcagtctgtctggatagtggtgggaagagcatacaccaacaccaactgtacgtatgtgatttcaagtttattgtggtacaatttacttctaataaaaatcacgctttcggccgggcgtggtggctcacatctgtaatcccagcactttcggaggccaaggtgggtggatcacaaggtcaagagatcaagaccatcctggccaacatggtgaaaccccatctctactaaaaatacaaaaattagctgggtgtggtttgggtgcacctatagtcccggccactagggaggctgaggcaggagaatcatttgaacccaggaggcagaggttgcagtgagccaagatcatgccactgcactccagcctggcaacagagcgagactccatcttaaaaaaaaaaaaaaaaatacactttttaaaggcatcgtttagtaaggtttgacaaataggtgcaatgaatgacataagctccccacaagcaagactcagggcagtcccacctgcccagagcatcctccatacccctccacccaggcgagcgctgccatgccatctatcccacacttttgccttttgccttttctggaatgtcatgttgagggggttgtacagtgtgttaccttctgcagctggcttccttagcataattgcttttgagattcacccgtgttgtgacaggtgtctgcattcatttgtttttcactgctgaggagtggtctgttgcatggatatcataatttgtttcttcattcaacatttcattgatatttgagtgtttctaattcggggctagtatgaataaaagtgctgtgcacatttgcacacagattttcatccaacgtgttttcctttctcttgggtgaatacctagatgtagaattcccagatcataagtaaatgcacctttaactagattctaaagtgcccaactgtcttccaaagtggctgcaccattaagaactctgcctttttcttaactcactaccccaggactgacttttttgaccccctgccctccgcccggtcactgtgtatggcaggtggaatccaccatgccctgggggtggttccacctgcagctgtggggagaagcatctgtgctcactgcacatagatctgtgccctcaatgccagcctgcacctgcctttctctacctggcacctggggcctcatgggggatggtgtccggcctgcaggagcagcagcctgactgtgccatctctcatctctccaaatgatctctctgtggaactttctaaatgacatatcagccgcgaagacaaataggaaataagaggcaggaggcaagacagacactccccatggagcggattccacgtggccctgggcactcacctcaggagtggttgagaaagcctggttcctgcttgctccatgaagtcctcactccttgaccagattttggagagaggaaggtttttcaataactgcccctcttggtagtcctcctaaggaagagcaaaagaaataaaacagattcaaaactgtgggcctgcgcagtgattcatgcctataatcccagcatttggggaggtcaacgtgggaggatctcttgagcccaggagtttgagaccagcctgggcaacatagcaagacacccatctctacaaaaatacaattaaaaaattagtcggatatggtggcacgtgcctgtgatcccagaaacttgggatgctgaagtgggagaatcgcatgagcccaggaggtcaaagttgcagtgagctctgattgcaccattgcactccagcctggacaacaaagcaagcaagaagagaggagaggagaggaaaggagtggagaggagggcagaggaggggaggggaggggactatgcatatcccagtagcctggctctgggctgggtctgtctgttgcttaaaggcttaaaaaaagagcacagagccatctgcacttggacatcctggtgacgtggcctaacttccgacattggggtcctgtaaaagaagataagccatggtgtttccttaatgagaaggccttaattccaaagtgagggctggcaaacccaacagcacagcactcagaggagaagacacagttgttgattgagtcgagctgtctggcttcccaggaccctcagctcagtcacagcacagcgttaccaggatgtcagacacccaagggcagtgctgacatgcagcctgccactgtggccacagcactcgggttaaaaagaaaccagataaaattcgtgtttctgcttgtccagactagaaattaattcaaacctggcctgtagcagctgtcttctctacatccaactggatggatgaaggccgtcctacctagtagagggaggttggaaggatgagaactgtctacaattaaccttttcattagcacagaaaatttagacaaccaaggtcccaatttctaatgtaaaggtcaatttcttacatctctgtgtacatcctaactgattcaccacaccattgcccgaaggtacatttctattggttttttgaaatgctaagaggagctctcaggcagtgttaatgtatgcactcacgacttcataggtaccagtactgcactagcttccagtatagcactaggtactagtactgcactagatactagcactgcactaggtactagcactgcactaggtaatagcactgcactaggtactgtggatttgaggggtcagaggggaaggaaaccattctgattgtcaaggaatttcctatatagttacagaaaccacattcattagagaatgagtaaattacctttgtgctcctattagactacataagaattgtacaatgtgatgtcctggggttacataagtatagttttaaatcaactatatctgcagcctgtgaaaaacctattccccttttttcctagttgcagttcactccccagttcgtctgcaccctacctcgatgagatctccccttccgtgggctaaacaaaaccccaagcagttagctgttaatgatacgagcaccatgccggagctagggccaaatgagtcagaagaatcctttgcagtgccgcggggccctaattgtgtcaggtattttgcccaaattagcatggctgaggatcggctgctggttctaaaatagtctcgaaggactgtctccaaattgcttcggcaacattactcattctcagcacgactctggtttccgccgtcccaatttacagatgggcagccgaaagggaaaggatgagatggctaaactgaaagtcacaaaggaaatcctgggccaacatcaccccttggggcttcctccagctgcggtctgtgcccccacagccccaggatgctgggcggttttctccaagaattggaaaccttttcccagggcatcctcacacaaagccccactctgaataacacgatgatttcaggcctttttctaatcataagcccccaaattagataagatcaacatgaaaggtctcaggtatcccttaagaatttaaaggaaggacagaaaaggttgagctctgtagtgcgtggaagaggagatggcatgatcaggatactgtcctgagaattagcagtaggatcttacagtgaaatagggggctcctccgcaggctcccaacacatcagctggtaattatgcccggcaccaggatactggggcaaggcagagccactggaacacatcctcgcctgcaccctgctctgctcattagccatagcatcaaaatcacttttgctccaaaggcgttttttttttcctatactgtacattcttttgtgctttctaatttattactttttttcccctacctgagctgttggagatttagtgttgaatggcttctctgtatttttctttagtctaattcattatcactaagtctgtggtttttttttttttttgtgatcaatatacacacttagattggtttaaaataatcccatggagagcctcattagtgtccttggataatagatgcagctctctgggagaagggagcgtttatcagggaccacagtgacagagcccacaagcacacctccctgtgtgtgtgttgaacatgctagaacatgcacatgtatgttgtcaggtcctcaggctgcatgaagctgctacatgtgcaccatgtccctgctgcgtccctgctgttcgttctgagcactgtgagagcctgaggcgtcagagtgcagctcattgagacccagacgccactagattctcagtcttctgcatgtttttcacacctcttatgtttactgaaactacatcttgagctgagtgtttgagcaatttgttctcaaggccaatatgggcaaactccctgagtcggagctgataccagcgaacggcttcagaaagtaaaaaacatgggaaagaggctgagaggaaagaacgctctgagtgggaagagaggagggagcacctgtctgaactggctccgttcacgtccattcattctttaaggaacttctctttgtccttcataaactacagtgttcccctgtctcccaggctggggtctcatggctcttgccacaggccaaaaagaaataagatttcctcttggcaacattttttgttctgtaatgggattttactgaaaggcaggaggaaaaagcccttgaggtgaccaaaaacttgtttttaacacatatgatgtaaggtaaaagctttaagaaggtaaacagagctgggcatggtggcacatgcctaacgccccaacagctcgggagaccaaggtaggaggatggcttgagaccaggaggttgaagctgcagagagctatgattgtgccaatctactccagcgacagcatgagaccttgtctctaaacatagatagatagattgacagattgattgataaatgatagatagatgatagataaatgatagatagatgatggatagatgattgataggtagatggatagatgacagatagacatatagctagatagatcaatccatggatgatagatagatagataatagataaataggtagatagataaatgatagatagatatagatagataataaatcaatccattaatggataggtgatagataatagactgattgattgatagatgatagactgattggttgagagatgattgatagatagaaaacaaacctgttttttagtttcttcacagagtggcacaagcatcatctcattccattttagaacattccacccccacctccaaattatgctttagcatttactgaaccccccaaactcatttctgcttccccgtcatgtcttcatttcacagagtttgttgagcactgatcttgatattaggtttacagtgacagagaagacacaagctccctttaattacaaagattccatttccgtgtgactgtgtttactacggtcagccctccatatccatgggttctgtatctggagattcaagcaacctccctcaggtcaaatacctggaaaaaaaaaaaaaaggatggttgcatctgtactgaatttgtacagactttcttccttgtcattattccctaaatgatacagtatcacagctgtttacattagcaattacattgaattagggattataagtagtctagaggtggcttaaaggatacgggaggatgtgcttacattatatgcaaataccacacattttatatcaaggacttgagcatctgtggattttggtatctgcaggggtgtcccggaaccaatcttccatggataccaaggatgactgtgctcatatttgtgatcatatatgttaaaagcatctctctgaattagagagggaatctgtcacatctgtcactaatattttagaacaggccaccccgatccatctttagtgagtggagcatctctgcctgaaaacatctatatccaaatctttctttctttctttctttctttctttttttgatacagcgtctcgccctattgcccaggctggagtgcagtgacgtgatctcggctcactgcaacctctgcctcccaggttcaggcgattctcctgcctcagcctcctgagtagctgggattacaggcgcatgccaccacacccagctaatttttttatttttagtagagacagggttccaccatgttggtcaggctggtctcaactcctgaccttctctgatcctcctgccttggcgtcccaaagtgctgggattacaagcgtgagccaccgtgcccggcccaagtgtttcataaggaaaggaacttctgatacaccatagagtgtctgggaaaattttaaaattactaatggaatatgtgctcaaatattggcccctgaggaagcatttatgcccatgaggattcctgccctcaaaaatttaactgtgtcatttagatatacacaaaaaatgaatatatatgaatatttaaatgctacatgagtttaaggtattactgaccctagccactcagtgactggagattagactagacccacttattaatccacccatccactaattaattattcaattaatatttattgagcatctaccatgtgtcaggttctcttttagaactgggagtgtatcacacatttttatattaccttccatgctaagtacataggaagactcagaaaacacatatgattagacactgagaatgctattttttggtgcctttggtgataaaacgttaggatccaggaaagcaattgttaggtttgccccctcactcccaaatgctgttgctgttataaagcttttcagtccctcaaaatcacttaggaagataaatgagtaaacttcgctgcactaatttactcttcaaatttcagcatgatttatgccctgttttgtttattgctcaaataagcaaaatcagaatggattgtgtgattattttgaaatatagttaagtccagatcactttattcttccttcatcatttttttttaactaatccatctctacccaggagatgattcatcacacagctgccagggctgctttaaaataaaggaataaataagaagaaagaaagaaaagtgaaggagggccactacatagccccaaagtaaatcactgtacaccttcctgcattctctttctctctgcctgtcttcctctctgtcacacacacacctctaagaatttcagcagaatccgggacatgctggaaaatcatttgatgcgaggaattggggcttaagccaagtgtgctgccgtggcctaaatgtgcaaggtggggccagggacttctcccgcaggaagccggctcaggccagaagcccagggggtgggcagggcaggggtcatctcccccagggtttgcctctgccttgctctctgagggtctccactttgtcccttcaggctttgactaaatcttcacgcagacactggtcagctacctggccctgagcaagtcgctttgggccttggtggaactgggaaatgaagggacattcgcttcctagggctgcggtgagaaatcgccacaaactgcgtggcttaaaacaacagaaattgcccctcccagttctgaaggccagagatgtggacacagttgaaatgacagtgacagagaagggtgtggaggagaggagcggggctgcggtcacgcccaggacactggattttaaagggtgggcagagaagatcccacagagacgaggaccagagagggaggtggggggagagctgggagaaggggcagtcgagagggaggtggggggagagctgggagaaggggcagtcgagagggaggtggggggagagctgggagaaggggcagtcgagagggaggtcgggggagagctgggagaaggggcagtcgagagggaggtcgggggagagctgggagaaggggcagtcgagagggaggtggggggagagctgggagaaggggcagtcgagagggaggtcgggggagagctgggagaaggggcagtcctgaacatcaagacagagaagcagcagccgcagcatgtgcagggagagaccacccaggcccagcacggggaggccacggactttggcacctcgatggacacagaagatcttcagagaagcaatttcagctttaaaaatggatggaagccatattgcagtgggttagggacaggagagaaggtcagaaagtggccctcagatttggaccactcactggattggaccaagaccggtaggcgttgggctgatgatgggttagaggctgcgtggggaggaggtgctcatgggtgggtggagaggctgcgtgggaggaggtgcccagagatgggtgagaggctgcgtgggaggaggtactcatgtgtgggtggagaggctgcgtgggaggaggtgcccacagacgggtggagaggctgtgtgggaggaggtgcccagtgatgggtggagaagctgcgtgggaggaggtgctcatgggtgggtggagaggatgcgtgggaggaggtgctcatgggtgggtggagaggctgtgtgggaggaggtgcccagagatgggtggagaggctgcgtgggaggaggtgcccagagatgagtggagaggctgcgtgggaggaggtgctcatgggtgggtggagaggctgcgtgggaggaggtgctcatgggtgggtggagaggctgcgtgggaggaggtgctcatgggtgggtggagaggctgcgtgggaggagatgctcgagtgggtggagaggctgcgtgggaggaggtgctcatgggtgggtggagaggctgcgtgggaggaggtgctcatgggtgggtggagaggctgcgtgggaggagatgctcgagtgggtggagaggctgcgtgggaggaggtgctcatgggtgggtggagaggctgcgtgggaggaggtgctcatgggtgggtggagaggctgcgtgggaggagatgctcgagtgggtggagaggctgcgttggaggaggtgctcatgggtgggtggagaggctgcgtgggaggaggtgctcatgggtgggtggagaggctgcgtgggaggagatgctcgagtgggtggagaggctgcgtgggaggaggtgctcatgggtgggtggagaggctgcgtgggaggaggtgctcatgggtgggtggagaggctgcgtgggaggaggtgctcatgggtgggtggagaggctgcgtgggaggaggtgctcatgggtgggtggagaggctgcgtgggaggaggtgctcatgggtgggtggagaggctgcgtgggaggaggtgctcataggtgggtggagaggctacgtgggaggaggtgcccagagatgggtggagaaactgtgtaggaggaggtcctagttgtctgcatttcctttgggagaacagccttagggaaaggaaagagactggtggagcaaaatccgagaggctgaggcagcataaaagtctctcctccatggaaaaacttggagccaaaagcgcacattcctcagtgaaagacgccaacctgaaaggctacactttgtatgattccaactatgtgacattcaggaaaaggcagacttatgggggccttaagcagatctgtgcttgccagggtttggtggggtgggaaggatgaatcggccgagcacacagaggtttggagacccaaaagacgtctgtatgatcctgcaatggcaggtgcaagacggatggatttgtcacaactcacagaacacacaggcaaagggtgaaccctaatgtcagctgtgggacttagttaataatgtttcaatattggtttatcaattataccacatgcaccacactaatgcaagatgtttgtaatttggaaaactgagggcaggggaagaaggaggatatgggaactctctgtagttctgttcagtttttctctaaacatgaaactgctctaaaaatataaagcttattaattaaaaatagtaataaataagaaaagtttaccaggaaggtaaatggaaagtatttgatagttctaggatggaacaaaaaaggaggtacaggaggaagtgctggccgagacggaaaggggatgcctggtcattggagactgagaggagggaggagcaccaggtacttcagtgtgtccgggaggaagccttctgcagggaagcagggaccctgggccaagctggagcctcccagaggcaaaggctgagagtgaggctgatggagagggaagccctgtaggcaaaagggagagggagtgggtgtgggagggagagccttcagtgctcctctgtctgccccacacctccttgtccctttagagtaagggggcagtaggtacaagagagatgtaaggagagcaggaaagattggaattggcattgaggacagacgtgtctcacactctgggtggttgtgatgatgggaatggttagtggtcagctgaggttggagacattgcatttgtcattcccaaaggtcattctcaaaggtcaaggtgttgatgtggaggaggtagattcggcataaaaccaagttgggcattcgctagtctgggcagagaaggagttgtgtgaggaaagccattcagtaggggattggagcagaggatgaatgaccaccaagtggctcatccaaaagggaattcccacagtggagaagaagttggaaaagtcactctcaaatcctcttttaacttgaaaggaaaagaatctgataccctgcaagaaatcaaattccaatgcaaaaatataggttcctttcataggaacagatgtggagaatatgattgaggattgagaccctaaacccagtttcccacctgacacagggattgagcccatttgtttttgctacagagttccatagagtaaacttgtcccaatatctgacatattactgggcctttaaaagaaattacatatagatagttgttgtaataacattttatcaatattcaaccattgatccttcctaattaagtgaagggttaagggaacacacatatacatctacacattcacatatatacgttgtgtgtattatattgcatggtcaaattatttaccagtttatcaatgaataaaccagcatttatggaatatctgctaggaagctctgtgctatctattttcacatacaatagattattgcgtccaaccctacgaggcaaacatgattattttcattttatacacaggaaacaaacttggatccagttactctattgcctcaagccctttgcttctagtggcagagttcagaattaaatttacaccttcttggaattatctccaccacttcacaacttcctccccacgaggaacatcctggtgtttttgaagacagattgccacgactcacttctggcatcttggagtcacttgtttaacttatagagactgagaaagattgagaggttgagagagtcactagctagcaaaaagaaaacaattacctctttggactatggtagagtttataaattaatagccattgtttctcttgattttcatgaccattctgtaggacgagggtagctattgtccccataggagaaaataagacgcagagagttgctgaaggccgtgtgatccacacgtcataaggttgggactaggatgcaaacttttgattcctggtgtggatctatggaaactcctgtaacgtgttggtggtgagggaagggaaatgcatcttagcttatggaagaagtaaaggactccttgagcacaggtgagccaggtaataaaagtggaattagtgaatcaccatcgcatattggccctagtgttcatgcagtgatggtgaatcaccatggcatattggccgtagtgttcatatagtcatggtgaatcacgatggcgtattggccgtagtgttcacgcagtcatggtgaatcaccatggcgtattggccgtagtgttcacgcagtcatggtgaatcaccatggcgtattggccgtagtgttcatatagtcatggtgaatcaccatggcgtattggccgtagtgttcatatagtcatggtgaatcaccatggcgtattggccctagtgttcatgcagtcatgatgaatcaccatggcatattggccgtagtgttcatatagtcatggtgaatcaccatggcatattggcgctagtgttcatatagtcatggtgaatcaccatggcgtatcggccgtagtgttcatatagtcatggtgaatcaccatggcatattggccgtagtgttcatatactcatggtgaatcaccatggcgtattggccgtagtattcatatagtcatggtgaatcaccatggcatattggcgctagtattcatatagtcatggtgaatcaccatggcgtattggccgtagtgttcctatagtcatggtgaatcaccatggcgtattggcgctagtattcatatagtcatggtgaatcaccatggcgtattggccgtagtgttcatatagtcatggtgaatcaccatggcgtattggcgctagtattcatatagtcatggtgaatcaccatggcgtattggccgtagtattcatatagtcatggtgaatcaccatggcatattggcgctagtattcatatagtcatggtgaatcaccatggcatattggcgctagtattcatatagtcatggtgaatcaccatggcgtattggccgtagtgttcatatagtcatggtgaatcaccatggcgtattggcgctagtattcatatagtcatggtgaatcaccatggcgtattggccgtagtgttcatatagtcatggtgaatcaccatggcgtattggcgctagtattcatatagtcatggtgaatcaccatggcgtattggccgtagtgttcatatagtcatggtgaatcaccatggcgtattggcgctagtattcatatagtcatggtgaatcaccatggcgtattggccgtagtgttcatatagtcatggtgaatcaccatggcgtattggcgctagtattcatatagtcatggtgaatcaccatggcgtattggccgtagtgttcatatagtcatggtgaatcaccatggcgtattggcgctagtattcatatagtcatggtgaatcaccatggcgtattggccgtagtgttcatatagtcatggtgaatcaccatggcgtattggcgctagtattcatatagtcatggtgaatcaccatggcgtattggccgtagtgttcatatagtcatggtgaatcaccatggcgtattggccgtagtattcatatagtcatggtgaatcaccatggcatattggcgctagtattcatatagtcatggtgaatcaccatggcatattggccgtagtgttcatatagtcatggtgaatcaccatggcgtgttggccctagtgttcacgcagtcatggtgaatcaccatggcgtgttggccctagtgttcacgcagtcatggtgaatcaccatggcatattggccatagtgttcatatagtcatggtgaatcaccatggcatattggccgtagtgttcacgcagtcatggtgaatcaccatggcgtattggcggtagtgttcatatagtcatggtgaatcagcatggtgtattggcgctagtgttcatatagtcatggtgaatcaccatggcatattggccatagtgttcatatagtcatggtgaatcaccatggcgtattggccatagtgttcatagagtcatggtgaatcaccatggcatattggcgctagtattcatatagtcatggtgaatcaccatggcatattggccgtagtgttcatatagtcatggtgaatcactgtggcatattggccgtagcgttcacgcagtcatggtgaatcaccatggcgtattagccatagtgttcatatagtcatggtgaatcagcatggcatattggcgctagtgttcatatagtcatggtgaatcaccatggcatattggccctagtgttcacgcagtcatggtgaatcaccatggcgtattggccctagtgttcatatagtcatgtgaatcaccatggcgtatcggctgtagtgttcatatagtcatggtgaatcaccatggcgtatcagccgtagtgttcatatagtcatggtgaatcaccatggcgtatcggccgtagtgttcatatagtcatggtgaatcaccatggcgtatcagccgtagtgttcatatagtcatggtgaatcaccatggcgtatcggccgtagtgttcatatagtcatggtgaatcaccatggcgtatcggccatagtgttcatatagtcatggtgaatcaccatggcgtattgggcgtagtgttcatatagtcatggtgaatcaccatggcatattggccgtagtgttcatatagtcatggtgaatcaccatggcgtattggccatagtgttcatgtagtcaagatgaatcaccatggtgtattggcgctagtattcatataatcatgatgaatcaccatagcgtattggccatagtgttcatatagtcatggtgaatcaccatggcatattcgccgtagtgttcatatagtcatggtgaatcaccatggcgtatcggccgtagtgttcatatagtcatggtgaatcaccatggtgtgttggccctagtgttcacgcagtcatggtgaatcaccatggcgtgttggccctagtgttcacgcagtcatggtgaatcaccatggtatattggccatagcgttcatatagtcatggtgaatcaccatggcatattggccgtagtgttcacgcagtcatggtgaatcaccatggcgtattggcggtagtgttcatatagtcatggtgaatcagcatggtgtattggcgcttgtgttcatatagtcatggtgaatcaccatggcgtattggccgtagtgttcatatagtcatggtgaatcaccatggcgtattggccatagtgttcatagagtcatggtgaatcaccatggcgtattggccatagtgttcatgtagtcaagatgaatcaccatggcgtattggcgctagtattcatatagtcatgatgaatcaccatagcgtattggccatagtgttcatatagtcatggtgaatcaccatggcatattctccgtagtgttcatatagtcatggtgaatcaccatggcgtatcggccgtagtgttcatatagtcatggtgaatcaccatggtgtgttggccctagtgttcacgcagtcatggtgaatcaccatggcgtgttggccctagtgttcacgcagtcatggtgaatcaccatggcatattggccatagcgttcatatagtcatggtgaatcaccatggcatatcggccgtagtgttcatatagtcatggtgaatcaccatggcgtatcggccgtagtgttcatatagtcatggtgaatcaccatggcgtatcggccatagtgttcatatagtcatggtgaatcaccatggcgtattgggcgtagtattcatatagtcatggtgaatcaccatggcgtattggccgtagtgttcatatagtcatggtgaatcaccatggcgtattggccatagtgttcatgtagtcaagatgaatcaccatggcgtattggcgctagtattcatatagtcatgatgaatcaccatagcgtattggccatagtgttcatatagtcatggtgaatcaccatggcatatcggccgtagtgttcatatagtcatggtgaatcaccatggcgtatcggccgtagtgttcatatagtcatggtgaatcaccatggcgtattggccgtagtgttcatatagtcatggtgaatcactatggcatattggcgctagtgttcataaagtcattgtgaatcaccatggcttgttggccctagtgttcacgcgatcatggtgaatcaccatggcgtattggccctagtgttcatgcagtcttgcaaggcactgcatattatttccagttagcatttatgggaatttacatttgtcgtatcaaagaaaagttaatcccctgctgtttctgaatatcttagatacctactgaaaatcataatctaacaaactgaatttcaatattaagtaaggcaatggagtttaagtctttctgatgtcccactctgccctctgtgcttagaaaattccaaataaacacaggtcaagtgaatttgttaggcttgtctctaaactttcaaaaggatctttgctgagagccacctctcgaacctacctttatttactaatttatttgtttgttcataggcacataatgagggcctgtgctgtgctccatatggaattctttttttttttttttcagtttttaaaatcaagatcacagtatgttgggagggcaattatctgacttttcattcctatttaggataatttttaaagccaatgagatataagctatgaaattctttttaaaaactttttattttgaataattgtagacacagaaaagttgcaaaagtagtgcaaaaaaatctcccatatttctcatgtcaccactcctagtgatagcatattgtataactttggtataatgatcaagaataggaaattaacatgggtgccatattgttaactcatctacaggcctcatttgaattctaccaatttttctaccaattttctacctgtgtcccaggaccccatgctgcctttagatgttctttcttcttagcaccctccagtctataacatttcctccatttctccttgtctttcatgaccttgcacttttgaggaggactggtcagttatgttgtagtgtccctcaatttgggtttttcccagtgttttctcatgattggagtaaggttctgcattttgggtaaaaaatatcacataaatgattatttgtccttcccattgcattatatccaatgggctccagtgatgttggccttggtcatttgcttaagtggctgtctgccaggtttccactgtaaatttgatgatttgatttatttaattatttatatcagtaaagactcatgggtatttattttattctatgggttaatccagtactaacattaatttttgttgttgttgatcaaactgttctagtatgagtcattagaaactcctttaggttagctttcatgttctctcaataaacccctatttttttagtattccattgctttctggtttcctaaaatattcctgactcattctgtattttccctgccccagcccagatacaattgctcctcccagaagccctattttcttttactgggtgatggtatttagacaccaagatctgggtgctaactgtgctcattgctactggggtgtcattgtttctaggccttctcagtggacagacgcaggacatatttgtatgtatactaacccatggacacacacatatctatattttggatctatctgtgtacatagagattaaaaaccatgagtttatacagatacctctgatttcaaacttcacagtttattttagtgttccccttttccttataacgttttttttcaacagtgaaaaacctggctttcattatctccaatatatttacatatttgtcccattctagcatgcacacagtctcaaaattgatcctccaaacccctgggagaaacaaatttactcacggaactacagagaatcttccttctctcagcagtcccatctttccaccctatttccacctataccctataggtaatcaatctggttcctggtttctgcttcctacatttcctttttcacaaaagactcgattcatatatattctcatatccctttcttctatgatatataattatatcatactatatacatacatatatgtgtgtatatatatatatatatacacatatacatacatacatacatacatacatactataacacatactcttgggctttgttaactctgacatggaaatcactccatatctgtttatagagttattcattctctcttacacctgcaccctacttcattgtattgggggggtatagttttggggggttttataaattgacaaatgataattatatatatttacagggtacaatatgatattttgttatatgtatacattatgaaattattaaatcaagctaattaacatctctatcacctcatatacttatcttttttcattgtggtataatagttaacatctattctcttatctattttgaaacatgcattacattcttattaactataatcaccatactctgcaacagatctcaaaaacttattcctcctgtctaactgaaactttgtatctttttatcagcacccccccaatccctcccactcccagcctctggtaaccactactactctactcactgctcaatactattcagccttaaaaaagaaggatgtaccgtcatttattcaaccacatattgtttccaatatttgcaactacaaataaaactgcaataaatacaaacttgtgcacatgtatttgtgcattgtttgaggtgaattctctaggagtctagaagtggaagtgttgggctgaaagttaagtgtgtactttattaggtattgtcagatgtctctctgaaatgattgcaccagcttgcttcccgacaagcaagtctgagagtgcctgtttccctacagtctccccagcaccatgtgtcatacttttttcttctttttccaagtctcataggtgagaaatgatatctcaattaattttaattcctacttccttaatttcatatgtatttgagtacctttcatatgtttgattgagggccatttttatgtctttttgtgaattgtctgttcatgtctttttctcatatttttatcttttttttttataaccacatttttcaaagtattttgtatgttagggatattagccatgtgttgtaaatacttttctcctggtttgtaagatgtcttttgtttatgatgcatctgtcatgcaaaagttttatgtttttatgtagtccaacttattaatcttaatttctggctcctgaattttgagtcatcaaagcttttctctacaccagggttcaagaggaattaacctatgcttatgagaatactttgaaacatcataacatacaaatgttggctgggcacagtggctcacgcctgtaattccagcactttgggaggccgaggcagacggattccctgaggtcaggagttccagcctggctaacatggtgaaactctgtctctactaaaaatacaaaaattcgccaggcgtcgtggcaggtgcctataatcccagctacttgggaggctgaggcaggagaatcacttgaacctaggaagcagaggttgcagtgagctgaggtctgccactgcactccagcctgagcgatagagcaagactccttctcaaaacaaaacaaaacaaaaccacgcaatgttaaaaactcatctattaacagaacctgcaatattaggactcgcttgcatcttccgatcactgggcagctgccttcccagctggtttctaagcggcaatgtcttctctgaattggcatcgtcactctaccctcaggcttcctggcttctccaaacccagacacttcatctaaaactacctggggcattctagactctctagcctcccccatctgtctttactctaaatgtagtccttgtttttcctggtagttttattcagccgttgcttttgtattttctattgattccagtccaccatgtccttagccccttcaccttccttcccttcctgcctcatctcctttgttcatgcaacccctgaagtgcagcatcctccctttccaaaggccattcaaccatttctttctacagatgagtgggtgcattcccagctatgtgtatattttatatatatatatatatatataatatacacatttttttttcaagacagagtttcgctctgtcacccaggctacagtgtagtggcatgatctccgctcactgcaagctctgcctcccgggttcacgccattctcctgcctcagcctcccaagtagctgggactacaggcacccgccaccgcgcccgactaattttttatatttttagtagggatggggtttcaccgtgttagccaggatggtctcgatctcctgacctcgtgatcgaccgcctcagcctcccaaagtgctgggattacaagcgtgagccaccgcgctcagccccacataagaaattatagctaagtgatagggcgcttacctgacagagcccagcagactcagcagaacacagatatcattcttcacgtggaggggtgtcatccaaaagaaacatgaaaatgaatcttttctacacgttggagacagcagtagctacaaaatatactgaaatatttaatacttataaaatgttagcacttttcatttttcccaccatgacctttactcactataacctttaagtacttagagaggtttttgttgtggtggtattggtatttaatcagtacattaaggataaaaaatataaggaggtttgaaaggaaatacatctttcaatttatccccttcctccctctctctctcgacttgtatctgtcaacacaaaccaacacaaaacctgatgccaccaggtttgtaaggtcataatgacctgcgttatacctagaaaaaattatcttctaggagaaccaaagatggagatacaaattgtggaggtagatcactgcatggttctgcattttaatttttaactttgactgttctggagatttaagaagttgatccaaagacctcactgcatgtcctctcttaatgagtatttactatttgggttaagcaatgatggacctatttcagcttcatataaattatatacatctgaagaaacctaatagagactaaatgagacatattacttagtaacacaagagacaagctcttgaaatggataccatggaaggagaaaggagttaagttataggtaggggataaaattgcagcagcttaaattcttggttcccaacattttgctttgtttttgtttgtttgttcaattttcagggatcctcaaagtctggacccaccagaagtcagcaatgcaaaacttcagtatgcaggatggggccctaaaggccaacagctggtaagccaatcaagttcagtaactatacttgggttttgaggaagtttctgttttctaagctgaatggatctcactgtactcagcctgtacatggtgttgtgtgtgtgtgtgtgtgtgtgtgtgtgtaaattaaaatctggagaggtacaccagggtgtctgaatatgtaaaagggtcatttctttttagatagcaaattctcctaaaattggaacagcatgtgcttggttcctacatctgacatggttaaagtggtgcctaactgtagctgtgtctatggactccagatgaatcatgagctcaaagagatcaacttcattaaaagaactgcagatgagaatgatccgaatgattttgtcatctaaagatgctctgggaactcagacttcttcctgtggagggtttttttttgttttttgtttgtttgtttcttttgagatggagttttgctctcgttgcccaggctggggtgcagtggcacgatctcagctcactgcaacctccacctcctgtgttcaagcgattctcctgcctcagcctccccagtagctgggatcacaggcgtactccaccacacccgactaatttttgtatatttagtagagacagggtttcactatgttggccaggctggtctcaaactcctgacctcaggcaatccacccgcctcagcctcccaaagtgctggcattacaggcgtgagctaccgtgcccagcctctgcggagggttttttaagcaagtagatttgctggccctgatggagccaggccagtcccgtcaacatgcaaaaccccccgtggtcattgcagccttctcggtttctatcagctatcttcatggattccttctcaaattggcaaaactgctgggtttctgtgaatgggaaggacagtgcagagaaaaaggccctgaacactatttctaagatgagggctcccaccctggttctcactgccgagctggccttggacagcacctcccgctgtcaggctgtaggcagcagcccagccatgtagtgaagaatttggataatacggtccttcaggtttgttccaactctagccttgcgtttgactaaaacttggttatatttgtccattctgggtaacatttttttaagacattgtattgccacgtgcagaaagtccctcaggtttgaaggtcagatgacatggttgctgttttcaagtcaccattttcttctgcctctttaagctgattacctaagcctgcatttgtaaagctcctttttcctaaaatagcacaaaaaatgatcgtatctaaaagctcccacagaattgtatcggataggctgtcatctatcttacaaatgaaaatagtcttatttctccccatagtacaatcacattttcttggttatatattaattccactgccttgaattggtttgaaaaagcaagaagatcgaggcggtgaaactattaatattttagctattattaacatgtctctaatgctaaaactgataacagaggttttgaaaagcatatgtaactgatcaaaatcacagggtgacaggaggaagtgaggcagctgagagctgaccttgaccgaggaacaccaatccatcagttcagtcacaacaaagagacaaaatttgtcttttctcaaaggcattaactcttacacagggaaaaaaatgcaatttgataagagattgtagaagatctaagttttcaggactgatgcgcaactgaatctctaatagttgactttaaaaccctctgaaagtctgtgattgaagagattttcaatatccatcaaatcatctgtgaaagtggccattacacctccatagagagctctccctgcctgctgcggatccattacaagccagtacccacagctctgcacctggcctcatcaccccactacagggagaaggatgggaatgtgtaaccttactgagtgatcattgtccagcctttttatagtagtcaggagaagaccatcataatgtgaccacatgtcaaggtctctttccaccatacctgcggcctcgcttcttatcacccagcggctgtaactcagtgtgtggactcctgcctcattgtctgcacatgcaaataaaccgggtcccgtagtagagttggtacttgtcctgcctctgggaacagcttgtaacataaaggaaatttaacccacaactgtaaaaggagttgctgtgcatgcatatgtgtgtgtgtgtgcgtgtgcatgcacacactttagaattaagtctataattgtcctcttgaacaactgaccttcactcatgtcatgctccgttggagatgaggaggggataagtgattatagaagttatcttgtttaacctcttacagaataagtagcaacaaaacaaagtaaatgacaacttctcagagaaggcttcctgacacctcccccaacacacacatgcacacacacacacacacacacacaatggtagctagccatcctggggcttcaggtttcaccgtgcaatctcccagcacacatgatctcttgttgcctgtagacatgtctctctccttggttaggtggtgatatggtgtggctctgtgtccccacacaaatctcacctttgaattattataatccccatgtgtcaatggtgggaccagatggagataattgaatcatgggggcagtttcccccatgctcttctagtgatagtgagttctcacgagatctgatggtttccccctttgctcgacactcactctgtcttctgctgccctgtgaagaggtgccttctgccgtgattgtaagtctcctgaggcctccccagcaatgcagaactgtgagtcaattaaacctctttcttgtataaatgactcagtctcaaatatttcttcatagcagcatgagaacaaactaatacaggtaccctgagtccacacagtgagactgtttcatcttcgtattctaacacacccagcacagtgtctggtgcccagtacacatttgttgaggtaaaagatgaaagcacaaacagattgattaattcattagttaatacatttttgtggtttcaaaccacttcagcatgaagaattggatggtggcaaatagccagcatctatgaatatgttctaggacagtactagaggtgacagaaatttgacttcctttctgcttcaaagaaatgaatgttcaggtaagtaataactgttaatacttgagtttagtaccaaaggtgctatatacttgtggaacttttgagtttttaaatccatttgacctttaagagcgttatgatacatgcatgtactgagcttaagacgcaatatagctcattgttgagtgagtaccctatgtgctggagcaggggccgccttcttctgcagaaggtcagatagcacatgtttcagtctttgcaaacagatagtttctagcacaatgactcatctcccttactgcagcatggaagcagctgcagacagtatagacaagatgggcatggctgtgttccaataaagctatacttcccaacacaggtggcttggcctatgggttatagtttgctgacccctgttttaggggatcatatgctgtcttggttgttctcatggggaaagcctgaccccagagccaccacctcatcacaggtactccccacacctgctccgtctgcacagaaaattcacaactcaagagcaggccttgcaagccctaacctattaagtgatgccaagcaacacacccctcattgccattttattttaaaaagtaaatattgctccctaaagtcaacctactctaattataatgagtcagattgaagtgagtaattctcctttgggagcagagaacacagctgcagttgaggtttgcaaagagctttgggaacatgtagcctcctgtgctgactgatttcagtgatgcctttgggtctggagcccctatatcacaggtgatgacccagggaaccagggatgggtgagggcatcttttcccagtgcctcgatgtggttgccaattagctcttaccttttagagtaagtgttgtgagacccatagaacatttctccggtagtaatgactgcagggggagtggcctgtgtgttgttagtggagtgggtgggaggaggcccccaggctgccagaagccacttctgtgatgatgctggtctggggctggagtttatgacaaatgacaagattgcttccaaacgtttgctgaggacccaggatgtgatctaggaaatagacttggccagattaaataggattaaatgagaaatcctaggtaaaatgttaacacagtgtctctcctttgcttcctcttcctccaaactggagtggtcagtcgggaaacataaacgttcaaaacatatgctgtttcaacgtatttctctgtaccacttctttcctcattgtgtcctcttcagatgaatctgcctgaactgagatttcctccatgtttctttcttttttttttttttaactggaatctccctctgtcacccaggccggagtgaatgttgcgatctctgctcactccaacctccacctcctgggttcaagcaattttcctgcctcagcctcccaagtagctgggactacaggtgtgtgccaccatacgtggctaatttttgtgtttttagcagagatggggtttcaccgttttggccaagctggtcttgaacccctgacctcaagtgatccacccacctcggcctcccaaagtgctgggattataagcatgagccactctgcccggccatccatgtttcttttctttgatcttttcatgaagtcctgcccccgaccatgtgtttgtctgtttatgggaggttttgtttctgctgacctagaatgtgattagttgtctggtttaggaatgtccacatatttcctgatatggtatttctattagagacatttcctggaagcacacagactttgaggcagccgcggtggccttccttgttcttggcacatgcacttggagttgaagctgcctcagggtgcatttgctggttgatctgcaaggggagggagggcatgtgaatttggtgcatcatcacgttttcctttggaaacaagtgccatggaaattttcccaagaaagactgtgcagcattaggcaacattaagaattcaaagccggaatctttgctggtacactcggaagatcagagacaaagtgaatgggtctctctttggttggcttgctaccatgatagtgataaatgaagagctttgaatgggaaatttaatgagtccattgggaagtcttcaacgcagagagcgtcaaaatgtgacagatgaagagcagtggagtagttagccgggaaacctgctggaactggggagagagctgtccccaagagatagcgttccccaaaggagcaggtgcaattacaaacaccatggagggaaactaaggaattctcacagccatgcttcacagcttagaaggaaaggccaacttcctcatcatctccagaccaagagaggctgaggggtggtgaatatcagtgagcaactgtcctgtgtcagtcaggagaaaaacatgtttatcaaaatgggagatttgagtcagactttaagaagaattgccttgattatatggcattttagatcctggaatagttttccacagaaggtcacagaatagtttatcggagaacgtcaataaatccgcatttaaattgtgctgtgttttactgcatgttctcactcataggtgggaattgaacaatgagaacacatggacacagggcagggaacgtccacaccggggcctgtccgggggcggggggctaggggagggatagcattaggagaaatacctaatgtaaatgacaggttgatgggtgcagcaagccaacatagcacatgtatacctatgtaacaaacctacacgttgtgaacatgtaccttagaacttaaagtataataaagaaaaaaagaaaaaaaattgtgctgtgttttaatggttaggatggcagctcccttggtgaagtcttaggagcaggtagactggactcccaaagatgttcccagccctagggctctctggaatggcacatgtggccagcgattgccatggtcacaagctagcttagtgcacgggaccctgcaggccggtcctgccgtgcatgtactttcctgtcattctcttatgcactcgtttgtttacggattcaatcaactcttcttgaatacttcctgtgttctggatactgcctgatcccggatgcagaagaaggacatggtccctttcctcactagcttctgcttctgatggcacattcacctattggcacattcactcgctctccccaaccgcgaatgctgcccgttgccctgctctggcacggtcactctcataactgtccccgtctgttcacactgcccaagctttcctctcctgtccacagcaggggctgtcacactatgtatttgatattcttctcatttttcaccaagatccttagatcctcaagtcttaacaaagtgatgcccctgaaaacaaagccatccagacaggcctcatcgcctaaggggtcattccgtacttgcttgatacagggcccatgaggccaatccagctctgagaaaaacttctctccaggggcggggacatggccatggggtgtgctgtctggaggtccagctgtccttacctcctacacaggtgttccgggctacagccttgcagcatgctgtctggaggtccagctgtcctaaccatgtgacctcctacacaggtgttccgggctacagccttgcagcgtgctgtctggaggtccagctgcccttccccatgtgacctgctacacaggtgttccgggctgcggccatggggcgtgctgtctggaggtccagctgcccttccccatgtgacctgctacacaggtgttccgggctgcggccatggggcgtgctgtctggaggtccagctggccttccccatgtgacctgctacacaggtgttccggctacagccttacagcatgctgtctggaggtccagctgcccttccccatgtgacctgctacacaggtgttccaggctgcggccatggggtgtgctgtctggaggtccagctgcccttccccatgtgacctgctacacaggcgttccctgactgactcacacagacactgtacccacaccctgcaccggccccaccttagtgattgctacaccctctcaagcctgtggcagttgtggctctctaagccacacctcagtgtgaagcgggatttaaggaaccagagagaccggatggagtgcaggagggtgtttattttaaggtgtacacaggcccagtggacatgtgtcctaaaggctgagcccagaacaaagaaaacgagtcccttttaagcattttgaggcaggaactacgtgaagcaggcttacagaagcgagaactaaaggctgctgtgacacttttgcaacatggcttacatctctgtgagaacttggtttgcggcttgtgcttatctgtcttgtgaccttgcagttgtggggggaagaaagaaacaggagtttacagagcctacaaaatatgtggaggatagatatggttattgtttcttgggacagacagttaatatactcttctaacttttaacttcagcggggctgcttaaattctcctcagccttggttaatacagaatttcattctatgagctattgttatttttcttactattattataatttttactattactacttatgctattattctgttgttttcttaatttcccacttcaagtggacggagcccattccaagcaaactattccaaggatagctgtttttcttcttaatacgccaacagcgagagagcgtgagccttcctttacctacccatgagcatctgccagtgatccagcgggcactgcttcctcccagaaccgtgtcttgacacttttttctatgaatcagtgaaagattcaagaaaattggagttgaggggttttttttgcactcgtgctgacttaccttatggcattggggtttttgccttcaataaaaataattttttaaagtagcccattaaaattgtaaaaatccatgccttcaaaatgtcagtaattcaacctaagatatggaggaagagcttgcgcttgaaactccaaaacgctttgttagagggacgaaagggcagtttgatagcagatcggagggatggagggcctttgcttcacccatcgctcacgtgtgggcgtctgcacggggaggagcgcgtggggagaaccatcagatttcagtgtgacagggaggccacgtgggtggcactgcagcagcagcacagagccagcgtgagggcaggctgggtgcagccaggagccagctgggagtgggaacccagccaggcctgggatgtggaagcccccactgagaaactcccttgtagggtcccaggccacctcctcagcctcagaatgggaaggtcctaggtaagaggtgaagccggctgggcttctgggtggggtgcggacttggagaacttttctgtctagctaaaggattgtaaaggcaccaatcagagctctgtctagctaaaggtttgtaaacgcagggatcagcactctgtaaaaacacaccaatcagagctcctgtctagctaaacgtttgtaaacgcactgatcagcactctgtaaatacgcaccaatcagtgctctgtgtctagctaaaggtttgtaaacacaccaatcagcactctgtaaaaacggaccaatcagcactctgtaaaatggaccaatcagcaggatgggggcgggccaaataaggaaataaaagctggccaccgccgcccaacagctgcaacccgcagctcgggttcccttccacgtggaagctgtgttctttccttcttcacaataaatcttgctgctgctcgctctctgggttcgcactacgtgtatgagctgtaacactcactgcaaaggtctgcagcttcacttctgaagtcagtgagaccacaaacccacagggaagaacaaacaactctgggcgcgccacctttaagagctgtgacactcactgcgaaggtctacggcttcactcctgaagtcaccaagaccacgaacccactggaaggaagaaactccagacacatctgaacatctgaaggaagaaattccggacacagcatcttcaataaccctaacactcaccgcgagggtctgcggcttcattcctgaagtcagcgagaccaagaacccaccagaaggaaccaattccggagaaacttgttttaagcgtgagaaggaaaagaatattttattttgtttgttttgctcttaaagggtcattagtaacaaaagctttggagtcaaaagggccagattcagatcgtggttgcagcacttactagttgcgtgaccttgactgagagacttaatccctgagcttccatctcttagtctgttaactgaagtaacagtgcctaccttgtagggctcatggtggagagtaaaataatctactcgaagtacaggctgtggagccttgtgtaaataacgttctcaataaatgtctttgattgttgctgcttttactatttgggttaatcgtctgagaatgagaaggaaaataagcatttcatcagatggaagtctggtgtgtgtcagaaggagagttgggctgcccttgataaagcagagaaacgcaggatagagacagaagctagggttggtgtccagagggcttcatgacgggccagcccccttgtccatcaccatccacagtgtacctgtgtggactcacaccttgctcttctcccactcttagggagggagggggaatgttcagaaaacaacatcaatttctacctcctgaagtcgtcagccccttgtaactattcaggagcctgtggctttagaaaaggccattgtcaggtgacagcaattcccctacgctaatgccacgccagaaattatcccttgaatggagagagtatgtttcttataagaagctgggtgtcctgcttcctgtatccagtccaggaagcctgcatccggtccgcagttccccattaccacctgggcaaccaccagggagctgagcagaaatgggcccgtcgcctcctcctacaagttacagcctggctcagggttagcgctgcccacccagtcccatggctgtagcaaagggggcagggagcactttactgaagtggacaaatccagcgaggggaggaagattgatctttccagcaagaggagagtctttaatgaaatgtcctatatgtggagaagaccagactaaagtgacatcccattaataacttataaaagcctctaatcagcttgggttaatttggtattcattgtaaaaacattcatcatgggcactgaggtctgtgacagtagccaagaaattaatatcccacggatggaaatggccttctgtaccctcagataatggatggagacagtttggtgagtgatttgttagcactaccaaagggacccttcaaatgtaacacaatatgttatcacttcctggctctgtggggctaaatcactttaatattcacttgcactcaagtaaataagctgagtttttggtaattaataggaatggatggggtcgtatgacagagatacctgatggtcatggttaaagagtgaggagaattaggaaataattatggggccctttcctgccaccaagaggctcttctcctgggatacagggatttcagaaaggaaatgcgtaatcataggattatgggggaagtgagagaagaaaaatataagtaggacatcaggaggaggtggagatttgttttaactctgtgtaaatggaggaggcataagagaaaatttatttataaaacaatatgaaaatatgcagaaagagtcatcaagacattcctatacaagatcacagaaatccctctaaaaagaagcccaaagctatatcaacaaacacattcataacactgttatccataacaggaatttctaaaagctggaaatgtcctaagtgttgagagctgagccatttgctaaatcatggagtatccataggaagaggtattatataaccatttaagattatgattaggaagactgcatgggagcatggagcatatatcatctatcaaacaatagcaggactaaaaataagccatttggtatgttggcatatggaaaggattagaaagtaatatattagtcaaaataattatttggactggccagactgggcttttttcccccttctaaaactttcttggttaaagcaacattatatatatattttttttaaaaaaaaattaaaaagagaagaaaatgtattgttaaaaatgggatttaggaactctactcaataaacatgtgctcaagtagtgttgagggtaaagaagaggcgctttttgcagagaatccaaacatgaataagccgcccatcaccctccggggatcacagtgccgttaattccaccggtttgaaagctctgttgcaaacccttcagagatattttctgggactcactctctttttgaaggagagaaagcagaataacaaaattcaaggtcacagattatgagtgtttaatatctaaaaattatttttaattgataagtcatcatcgtatacacttacgggatacaagaggactatagtcaataataatgtgttgtatatttcacaataagagaatacatttcaaaaaaaaaatggtaagtgagccttgagactcactcttaagccagaacaaaattaaggaaaaggtggatgcagggttaaaaccgggcctgacctgcttgcccacgttggccggtgaagataaaccctattttcttcctcatagcttccttaattcaattgcgactgaaacagtgtatcatttcttaggaataatcaaatttagaagggtgcccccacatcagcctcggcaatattaggttagagaatttcaagatcatttatcaaatagaatttaaagcaggaccagagttgtacattaaggaagagtgcacttagtgatagattcttgagagaatataacaaggcagttagttataaatgaacataaccttttgagacctttggatgatggggcgtggagccgcaccacacttgcggccatggcagatcctgtttctcgtcctgtggagggagcagcttctgaacatttggaggcttttccggtcgcctcgggtagggcgggggagggctgtactcggtgctgccaagaattctccttcgtgcacctaatcgggttctgtagattactttgtggaattctcccgtttgggtggagggaacacctcttcatcataattcctaaatgtttcaccattggaaaatatcaaagtaaaggttccatctcctggtctttgtagaataactgcgaccttttcttcctttaaagtgctgaaatactgtcagtcccacttactgtagcagttaatcttatgcctctttgttttattattcaactattttgcttttgaataactttatttcccagaccaaatgtaagctgttgaagaacaaagaatgtttttcattagacttttgtcttccacagcccgttgctcagcattgtgcagagtgtaggttctcaacaaatacttgtgaaatgaatgccatccagaagggaaagtaaaattaaatgtcagatttatagacataaggtccaacattcatggaaattggaaaactttgacgttataacctaaaatttttgagatttaacaacttgtctgatggcaaattaattcagcagttcagattcagttcagattgtgagcaataccaaggaagaaaatctggattttcgagtcagacatttgtcttaaaatgtttgttatgctgtgaaagatcttaaaaggaagatagagagtgctcctgattaaaacctgtcaggatcaggctgaactcaacaaggcgaaaggacctgaacttcttgtctttccaaggacgtttcagaggatgaaagcgcctcacttcttgtcccactaggacaccgaggtgatcgtctccgcagtgtcataaggaacagtgaggcctcgtgggcttgtgcccctcacgcactctccggtttgaaattggggtcggccctcattctaatgccctgtgagggcctcagaggttattgtctgggttgttaaacgtggagacagagagggcacagaacagaagataatttgctcacttaaaacaagaggtttctaagaacgtttggagaaattttagtgtgtccaagtcagttatttgtgaatgattcttctggacctttctgcaaagtagacttcacagggctcctcctttgcagaattttgttagccctgattgattattagaggttaattatcaatactggatactaacgtacttctgccctttgacgtgggtatttgcacagcccacgaggttttatttcacttctctgatgtgtggggaacacagtgccttactcgtgctagagcagtgatagacgtgagcacagataatcaatgagtcaatttcaatgacagaccactttggtttttttttagactgtgggttttacttttgttcttttgtttcatttttttgttgttgttttgttttgttttttgtgtaatagctcacatctagttcagctatttccactctaaaaaaagttagcaaattagtgaattgatttttctgtttgttcttcagtttgaaaacctcttcatttatctgaatggttttagttttccctttaatggcttttatggccaggaactgtttgaaatatgttttaatttcctccattaggccagatttaattaacgtacactatgcatgttggtgagctgagtgtgccgtctgacctccagcctagatcgctctagagcctgcgcctgtcccgtgagtgtgaggccaactgtgcactccagactcagttcattcataaatctaaactcactattgtttctgccaaagctctgccctgtaagtggtaccaccatctcttctgtgccaggtcagccaaattcttgactccccttcctcccccaccggcttgatccactatacattttatgaattctgctttcttggtatcatgaaaatccaccttcttctttctgttcccaccatcacctcatgcctaggttcctgtaacagctgccttcttggtttttctaccccaaaactacccctactccagaatgttctccatctctcactgagtgatctaaaatgcaaatataatcatgtccattttcccatgtaaaatccttccactgttttccactgcctttaggatagaacccaaaccccttcacatgctttgtgaagcccacctgaggtgccatcactcccctgacctctcctgccacccagtactcccaggctggagaccagccataatgagctacatccagttccgcaaatgtcccagaccacctctcactgcgaagactttgtatttgctattcacaaagtccagaacacactctttttttaaaaaatgttttaaaagaccatgtctagctctatcacccaggctggaatacagtggtgtgagcatggctcactgcagcctcaacctccttggctcaagcgatcctcccacctcagcctcctgagtagctgggacctcaggcacgtgccaccatgcctgtttagttcttgtattttttgtagagatgggggtctcactgtgttgcccaagctggtctggaactcctgcactaagcaatccttctacctcaacctcccaaagtgctgggattacaggcatgagccactgtgcccagcccaggacacactcttaatcccccacccctcacccctaactccaatccctgaagattgggcttgagacccctctgctctgtcccctgccactctgccattgccttatcaccacactcatcactctctgcttttgtgacctgtttccttgttattctcccccagccaaatccaagctccttaggaacaagcacctctcgtgttcactgctgtgtcctcagccactttgtgtagactgttagtaagcattaaatacgtgttcaaaggttgaatgggtgactcagtcaattaaggcatattatttacccaagatgaaaatcaattacttttttcaatttaagcgtaaactcgatttatgaatttttatgaaatttgtttctgtgttttcacctattggagatgttggctgacctttcatctctagccacaccctgtggcatcctcctttaaattttagccttttcagccaccacatgggtcccaattaccatgacaccgtgttcaaacccaggctcaccagtttctagttacccttcagataaaaaggttatgattgcacgtacatgtatctatttaattaagctagttttctccatggccatacaaagtcgtgtttctaaaattagctgggtgatctgactgtttagtggaacttgagtctttagaaggtcctcagataccactgctgtctacttcctgtaaatctaatcatcacaggacaaggtgcaggataggcttgcttagggaatgctgccttttaaatttcctatgttactgcatgacaagattagttgactctgataactccctacaaaagactcagaataataaaggaataaattaatcagtcaatggaaaagcaaacgatctataccaggctgatgaactataatagaacatctcattgttacacagagtcagccgtctcccactgccctgctgaatcctatctgaacagtaaatctgtgttgtaacagagccagcatggcaagcagctgctcagctggcctttcccctcctgtctcataaagaaaaatgccaatgtattcgtaatttcccagtgaggtggcagagtctgtaaatccttttttccaataaccctaaaattttactagccaacggttcaacagcctggtacacatttagggaaacaaaaggtttatggtggcagatgattgtttagaataatgtttcttaactcagctacacttcaacttgtgtaactacgaatgctgtggctgcatgcccagaggctctggttcgtttggaccagggtggggcctgggcgtcagggtatttgaaagctccccaggggcttctgatgtacaaccatgtctgagcatcctgggtttagatgcttacaggcgggactgggactggatgacctctttaataaactttgaagtttcaaggtcaacattccaacttcataataaaatatagaatctcttagattatatttttaatcaccaggcccatcacaagggaggtgctgaatataaaattgctggtcattaaaacattgccagggaaattgttgcttcaaaaaggcagctgtacttccttagatcaacatgcatggcttggccacgttgtagtttactttgctcctggtcaattcaacttaattcaactcaaagttaagatcaggatgtgataaaattattttgttttctttttctttgaatcctggatgagaagtcattgtccaaatcattaggtgttttatgcaatattaccaatctttagtgtgattttccccccatcaaacctataaacaataaacttttctaaaagaaagcctgccatgatggaagcactgggtttcagacagcaagtctcactgcatggctgtgcaggttgggacatactaacttgtgataacagcggccttttagatagggctcacaatgttcccaccaccatgctaggcactcagtgtattactgtctcttttgctcacaatatctctattcagcagtgagaaaatagaaattcagaaaatggaagtaattttccccgggtcacatatcagggatggtgtcagaactgaaactgaagaagtcgtgtcccagcttcttcctttggaccgaactcttaagtctggactctgttcagaatgacttctctcaagaccaaatgttctcaagtctatgagaagcctttgaacacctcttaaatgcactgtaaatacagtgttattaccatgaacgtgatatttgtatatttgtattcaaggccaccataaggatttttttttttttggcaatgcacagaagctggatgtctcccgatacagcatctggtgtaattaatccgacacccttatctctccccactgagcattctcaaagggaatgaaacattgacctaactgatatttccctctaaaatctttgcaggttccataaatgagctgtcagagccccagggcagacactgaaccccaactggaataaaacgttcctcctggagagggtgggtcagttatccagcacagcattcctcacatcccaggggtgtgcagagccctttcagagctggatcaaacaaatgaagcttgtatgtctccttttccagggggtgacctaagtatttgatgttagttttctacgcttcattattttttttatttcggatgcattttaaatgttaatgaaatattttatgaataaagagtaataaaatgagcactcacatgccctccagtcagcatgaaatacagagcattcccaagcatgcccagagctcggactccaggtccaccgggttccgggtccctcctccaccagaccaaccactcctctgaattttctttatgtttccctgccatttatggatctctaaacaatataccatttacattttgaacattatgtaactgttaccagacagtatctatactcatgtgacttgaggttacatcaacatagtatagatactgtctgtcttgtcactatacagtaacatgagtgtagacgcttgatgtaccctgagtgtacatactgtctggtaacagttacatcaagttatataaagtctcctatattatcttgtatgaacatgtggaagcattagctgtaattgagtctttttcagttttctgtcatagtccattatacaaatgtatcacaatgcctttatccagtcctttgtccatggatatttagttttctatttttaaatgtatttacagttttgctatgtgcattttgctcatgttttctggtgcacatgtggcaaagtttctgtaggttttgctgtgtgtatatttcattactgatggtgctgaacatctttgcatgggtgcattttctattcatgtcacaacttctgtaaaacacttgttcatgtcttttaacctatttttccttcgggttgtttgcccctttcttattgatgcgcatcatttctttatacatttaagattcaattatttgtcaattacattatttccaagatcttctctcattttacagcctgtcttttcactcttattttgatattctttggcaggaagatacattgatttcaatgcaatttattcctttatggtttgcatttttaagtcttcttgaagaaattgtccctaccccaaggacatagtctcgtagattatcttgtaacatttttttactttcatctttgacaattatgtctttagtccccctgaactggatttttgggaagggtgtgacgcatgcttacaattatctttccctaggaataatcaattgtcccagaacaatttattgagaaagtgttcctttccttactgatctttggagcctctgctatttatcaaacttctgtgtatgggtggatttgctttcagactctccactgtgttccactcatcttttgtccactgttgtaacaacaccacacgttcttactacagcttcaccacacagatggggcatttggtacagccagtcacctgggcatgctgctcctaagagtgtcctggctgtccttggccttttgcatatgtgtatatatgtgtcactcatgcacacacacaatttagaataagtttgttcagttcctctaaaaacactattgggagattagtgtgaactgcattaagtctatataccaatggagggagaatttataaacttcagctgttgaaactttcaatatgtggtatagttcccagtttatttacttaaaaaatactttctccataaatttttataattttctccaaaacagcttgcaaagctggtttaaatttactcttacatatcttctttggatatttttggtacatgtttcattttgtaaatgtaatttttagaatttatgtctgctagtgtattagtcagggttcagactaattagttagagggacagaactaacaggatatatatattaacttacacgatcacaaggtcccataataggctgcaagctgaggggcaagcagagccagtcccagtctcaaaactgaacaacttggagtctgatgttggagggcaggaagaggccagcactggagaaagatgtaagcttggaggtttggcccatctctctttttcatgtttttctgcctttttcatattctctggaagctgattagattgtgcccacccgattaagggtgcatctgccttccccagcccactgactcaaatgttaatctcttttggcaacacccacacagacacacccaagattaatactttgtatccctcaatccaatcaagttgacactcagtattaaccatcacagctggttaatagaattgcacttgacattttctattgattttgcatccagcagccttgctaaactcatttacttccaataattgatctgtggtttcttttggatcttgtatttagataattacaccctctccaaataatgacacatttatttcttcctttttcatcctcaactctgccttatttcctgatcttactccactctccagaaccacccacactatgttgagcagaacagcaatagtgaagatgcaaccctcgccttctagctcatcatagaggaaatgctcccaagtttttgccatggaatgtgaagttgctgtagattcatttgggaatgaccttggtcagtttcaggaaggccatttctatttctagtttgcacgatttatttgggaatgacctcggtcattgggttttgtttctttggttggttgttgttgttggtcttgtggtctgtgttctgtttgtctttattttgaatggattttgaattctatgaagtatgttttctgaatctattgaaatgatcatgtgggttttttttcctttaatctgtcagtgaggtgtattgtattgtcagtagaaaaccagccttatgtgactaggatagatgtgattgattgggatgtactttttaatatatacctagctagatttttttaacatattttctttaggatttttgcgtctgtgttcatgggtgaaattcgtctacactgtgggacattattgaatttaaaatcagtttattagaatggtaggtacttaagtaggtacaaacacaaaactatgcaactataaagccatatataatttaccaattcacttcaacaaatctacgaaagcaggaaatttaaaaacaattatatcaatttgcagtgctgatgttttactgaaagtctctggcagctggaatatgatgacaatgctgactgctccatgaattttcctttcttctcctgcattaccacgtgacttgtcatgacttaatttcccatgcattttctttatttgacctatagagaaaccttctttggaacaatacagccatgttattgttgctttgcttggcaggaatacatctttcgcatgtcaagtcccttttattcttttctcactggcccacaataactaaagcagtactacttggcaccagtgtgcttataaacataaattcaggccctaaaatcaggatagaaggacttgcttattggatagtcatccaggtggtccacaatatgggatatacattttactaagattctcatcaaaatgaacatatgaaatgtcagtgttttataaggacctgtgtcctcagattcccaggttgttatcactcagtttgagaagcatcccatccagagtttttacagaaggaattgttagtacagtttgctaggctgcatttgaaccaatgtcggccttcccttaggaccagcagagacggtaagcagaacttaggtgagtggtaaggagtcttttagagaagtcctcctccctcgagggcctcactcaagatctgactttgtagaaagcagaacttcacactgactttgagtaactgtcttccatgatgagctggggagagaatggaacggtgcccatgagactgtaggacttcatgaccttcagctgtttctccacacagagtgctctcagcctacagcgagagaggaatgatcccaccagctggaaatagagaggactgcaacccaaaccaccccccaccccgcatcatgaggcagcaagagttggacatatcttctccccatcttcccctggacacaccctacagaaagtcctgtggaaacaccccactatgaggctgccttattctcatgttagcctgatttgcaatagggaaaatgttgaggacacaaaaaaccctggctttatttgccctgatcacttcatcctcatggtggtaaaaatgccccatccatgcaacaagtcttcaagcacctctcatgtgccaagcagcccctgccttaggaccacccgctgttaagtgttcactggtgatgccactgtcttaccttatgagcactaaatgcttaagcagggctggtaaaacatagaacatttctcaggttattgtttcaaaatacactgtggttgtcaggcggaaaaggtttccctcttaggatcacctgtgacgagcaacgtcaaagtgttttggtgcaactcaaatgctttgctggaactgtttttctccatacaatgtacggggaaggcttccatgtcatggaacaaagtggtgaatgttcaaatggtcagggtgtgatttcatgggctgcatggattaaggaacattgaaacataaagttgaggacattgctctgttttcaattctctcaaacttctgttttccgatgaggagcatgattttgacacctcctaattcttgctcatgtctctttttaacaaatggagagtgagcctcaggcccagaactccaagcaggactgggcagaattcattatcatgttttggttttttggtatttattttatgcttatcattacttcactgcaaagaatactggtgttccatttatagtagtaatacaaaatgtccctgataaatgaaacttgtttacataaagagggaattgactgaaaagaaaataaagcagccgggcgcggtggctcactcctgtaatctcagcactttttgggaagccgaggcgggtggatcaggagttcaggagatcgagactatcctggataacatggtgaaaccccgtctctactaaaaatacaaaaaattagccaggcatggtggtgcacacctgtagtcccagctactcaggaagctgaggcaggagaatcgcttgtgcccgggaggtggaggtggcggtgagccaagacggtgccactgcactccagcctgggtgacagagtgagactctgtctcaaaaaaacaaataaataaataaatgaaagaaaaaaaggaaaagaaaagaaagcaaataatagtatcagaggtactcacaaaggtggttagtgtttaaccagccttgggaagtgctcctgtcagggaaggaagccagggtttagcaacaacacacgttgggtggaaacccagccctcactggattgatgatgtgtataacccctctgagcctcagtttccccattcatgaatagggcaaaaagacctcccagggatgctgtgaaggttaaaggcaataacttataggcagcattccttatgtggtaaatgttagttccctccctgatgttggaggagaaatctattattatcttgaatctgggccaaagacataataatatttgcataagtgatgaaagatgacaaaatggaaaaacatggacttgtagcaagacaagcctattagctttttcgaccttgaaacttctgatttgatttcctaatccataaaatgaggaagattaagatacttattttgcataattattgggcaaatctgaggtaatgtatgtaattaagtcacgtcctagtgatcacatcaagtacagagtaggcctcaatcaataacagctgtttgttatggtcctcactggggaaggaccatgactttccttcctcatgtgagaacctcctttatctttcaaattgtatcctcatgtgcataaaatattcttcagagtttgtagggaaatcgtttgattaatgttggggtcaagaagcaacaaggtgttgcggggacatcctctagagccttgagaatttggggtgtgaaattctaatttctgagatgctgatgtagctacagattctacatagagacccactcacctcattaattcaaggttcagggcactgaaagcgcatctacccatcatccttttctctttttcatacttttatttgaaaactattattctctctctcttttttttttttttttttgagacagggtctcactctgtcatccaggctggagtgcagtggcacagtcatagctcactgtagcctcaaactcctgacctcaacctcaagcaggtgttcctcccatctcagcctccctagtcactgggactaccggcacacaccactacacccggctaatttttaaattgtctgtagagatgaggttttgctatgttgcccaggcttgtctcaaactcctgggctcaagtaatcctcctgcctcagcctcccaaagtgctgggattacaggtgtgagccactgggcctggccctctttatttttctactgacaattaaccttctacttgaccagaggtctttttaaggattaaagagtggtaatttggctcccctaaaattcacagctgtgagtgtgctgtgagttgtgtgacagctgcattgcagttgcaattgtgtgctagtttctaacaaggggaagcaaacgctgacgtggccgagaaggaaggcccttactatgaggcttccgttaagtctcctccaggtcacattttcataacaccaagtgatatttttcagcttgaatgtctcctgatattataaggagtttgaaattttcctttattaattaacattttcattttgctcacattttggagagcactgattttccagaagtgctaattaccaagctcacagcagaaggttggctgcattttaaactatttcctcagatgctccctgctgaactcagagatgtcctcattcagccgagccagcctcccaggtgggtgggaggcccctggctggtgccactcacagactttgggcttcttctgaacccgcggagccctgaaacaccaataggcccacactcctgagggggttctggccacatctgcctttaggaaagatctgttcattggtgtaaaaccctgacgtgtgacatcagaaaaccagagcacctggccatgccccaaccctgtagctccaggcagacctccctatgatgtggcctgccatagtcatgtggctcgtgatgagtctagaaggcctggaagtttctgtctaagtctgggcaaaaacagagggactcacagcaccccttgtggtgtgagagtaatagatgcatgcatacatgtgtgaaggcttgtttgcagatgtctccatctgttatgtctgagcccattcaggctgctctaacaatatcgtagactggggtgcttagaaaaaacaaattgatttttcatcgtcctggaggctggaagtcaaggttaacttgctagctgattctgtgcctggtgagggcctgtgtcctggctcatagactgccttcttctgtgtcctcgcttggtggaagggacaagggacccctctgtgttgtcttttgtaagggcactaatctcattcgtgagcgttctcccctcatgacgtgatcatttcccaaagacctcacttcctaataccatcccattgggggtgggatttcaacattggaacttggggaggacacgaacattcaatgtgtaacaccataaagaagacatgggaggccaggctcagtggctcacaactgtaatcccagcactttgggaggccgaggtgggtggatcgcttgaggtcaggagttcaagaccagcctggccaacatggggaaaccccgtctccactaaaaatacaaaaattagccaggcatggtggcgggtgcctgtaatcccagctactgggaaggctgaggcaggagaatcgcttgaacccgggaggcagaggttgcagtgagctgagatcacgtcactgcactccagcctgggcaacaagagtgagactccatctcaaaaaaaaaaccagaaggcataggaatctggtatgtatgtactaatcttcaacattgacggtccccagcctttcaatccttgatgtaagtgatgaagatgagcttctgatctctcaaggcccggcggacccctttcctaaacctggggttaccattttcccatgcctgggggttttcccaggacattcatgctgataccaggacagtcccgggtaagcgggatggttgctcatgctgttgacaaggctctggggatcttggcgccaccaccttctcctcgtgccacacacacacatgcacacacaccacccatgccagacttctgaatctcatcttatgagtccattaattcactgttccccacctgctatatgtgcccaaagatttgagatttgcatagacaacattttgaaaagttttatcctctgttttgtcattaaaatagaccccgtgggtgggtcagcaagtgatattaggaagacgggggtgagatggtatcaaatgaagggaagactacagggctggcggcaaggacacagatttggggtagcagccagacttgggaatttggtgagggtgcatgacgcccaagactattgcagagcctgatgcctcggcccccgggtacctggaccacagtggcagggcgccagaaagggctgtgagggaactaggtcagcaaccaaaaactcacaggagtcaaacgaatactatgagccactatgtttgcccagagctgtgctagtgtgtgtatgagatttttaaaaagggaaaacgttactgttgcctgaaggagattaatatgtggataagacatacatacatgacagaaactaagaaagttattacaagattttaaccagagtcttaccaccctatttttaaggcaggagaattgtatgaaatgattgctatagttcagagaggtgaagtaatcctctaaatcacatagtgatttggtgttttgtgagtttggagaaggagaggtgaaggtggttctggaaggcttcctccaggagatggggcagactcgggctctgcagagcaggcaaggtcatcagagaagcggagcagcagagacctggaggcaggctgtgaggtggctggcgctgtgtggatcagggaggtgccgagggtaggagaatgctggcctggttctaagtcattggccctgcggcacgtggcctgtctggaaatgagttcctgcagacactctggacaggcaggagacctcaatgggcactggggcaacctgggccagctgtaggcttccttcctgatcaaacaagcggaccgtgctgagacacctccccgaaagccacaggtctcagccccttcatgggtgaccctgtgttatccacctgagaaagggcccaaaagaggcctctcagaggaggcaggccctgtggcagcacgggccttgaaatcggcccccggggcccctgtggcttcagtccagggactccatgccgggcgctgaaccacctccacaaaactcatgcgatcctcagagccccgcctcatcagccggaggacaggggtcacctgacagtgtgtctgaatgagcggaagcttccgttctgtgagagctctgggcttttgtgaactgacacggggcacagccacccgggcccctgggtgtggagtaacctaagaagtcgtgtacccctggggtgatgaggattgaggctaagatgggcagagggagaggaaaggttacacgggacccagtgacaggagtcgcagtgagttcagccctggtctgcccagagcagtccaagtttacccgggagtccaggggaagtcacaaatagagcttcctttcatgtgcaaatgtcccctcatttggatgataggttataggaccctcctaagtttggtgacttctgaggtctcaggctaagacatttctttgaccccactacagatgaagtacattgtttaagtgttggagggagtggcctagcccagggcccagagctggagcctgccagcctggtccccatccaggcccttccactcatgggctctgtcctgttgggcaaatcacctaggctgtctgtgcctcattttcctctaatatggatatcaacatagcgcccacctcatgggcttatgaggatgtgactcatactatgcgtgatgccgtgttagcctttgttaatgagaacctcctggtcagagctgtgctgtgggcagccaaaggccgattatggagaaccacccagagtggagttaggagccggcctcggggggccggtcacagagtggctcagctggtcagaaatcatgtctaagtctcacacaggcaggaaaatgcgacagtgagaaagggtcctgtcccagcccctgagagagtacgattctacaaagaccctgacacctgctcttgtgactgagttgcataaagtaggggttgaattcctgagtccactaaagacatgtacttccagaatggtaggagtgaaagaggggtgaacatagatggagaaccaagggttttcccaggtgctgtttgtaggtcacacaggggcacagtattgatgggaaagtcagcctcaggcatcatgtgcatcattcaaggtgtcccgtcatgttcctggcagagttggcttcatatccaacttgcctgactccacagcagcctccctttaaggaggcttggacaacccaggccgccatgaccggaaccccagaacctgcccacgagaagttgctcctgttctcctcctcccctgcgaggctcctctcaggccagggcttccaagtcccatgtaggcctccagagccaagacccctgcagcaccctgtgcactcaggcagaggaaagagcccaggatcctgcacagccccttggctctgctgtggcctctcatcgggccccttggcattccaggtggccctgccatcccacagacatcctccaggaagccaaggatgggaaggattctgaggtctgtttggcagaggtcacatggatacgttatgggagaggagtggtgttctggcaccccatggcttgaaggtttccattgttttctctgttgatataaagactggttttcagacagaggcaataagggaagaaacaataagtgagaaggtgaaagaggtcagtgttagacgtaaaaatgccacttcttctgcaaggttttcttgaactcccaggttcgaattcccaccaccttcagccatggcgtgcgcggctctgtctgtacactcagtgtacagtaaacatttgtctacaggtctttcccgtaacttgtgatatcccacacagcttaggatggtggcatatttattattttatcaccaattcccagtacaggtgctaggttcattttaggcatttggttgaactttatcatttatttattttcccattataaaaataatacagaatatagtaaaaaataggaaaaaaagcctttttaaaatagcatcaatagacccagtatctaaaattactattaatattttagtatgttttctaaatctatttccaagaatagatgtatttttttagttacaattattagttttacatcccaaccttttgatacaattagcattgtatacaattaaatacttattgttaacataattttcatagttacatagtatttcattgagtcgatctaccaaaatgcaattaaccattttccagctagaccagctggaccatgtataatattccctgttatcactgatgctgtgaagcacctttgggtctaagatgttccttgagtggaattactgagtcaaaaactaggaacacttttttatatacacttttgatgtatatttgcgaattgtcgtccgtatgcctcatcattcatcctgattccatgctcaccagcatcaggtgaatatgcaattcgttttaaagagaacttgctaaggctatgattttttaaaaagatctctgctaatataatttaattgcatagctatttaaatcagcatatatttaattatattctatagttaattaaattcacatatatttaatagtaaattgattttctgtaaagtaataccagtgatatctttcttgtgattttattcttgctccatttatcttttaatgtcttggtgtgtaaataaccaaaaagctccctgaaggggaaagacagcggaaatcggaaatcacctctgagtccttcacggtccagccaggagctagtctcaggcgtagcggagcccctgatgcccatgccagaggcagcgacttctgagctgggttctgtgattcccctgctcatcctctaggaggcactaatgagcagcagtgagctgaggaagacgaagagccagaggactccaaaacctggaagatctgagtaacctacagacgggataacgagcccctgtaggctgcagagaggttggctgctggtcacaccaccctggagaagagcacggttccaagatcagccacccagggaacctgggagggaagcagacactgtctgagaagggaggggattgatgacttcactgaaccctgaaactgatctcatctgctccaaatacctgggatgatccgggagacttagccaggaacatctgaatgatgtttcatgggtagcattttactcttgctagaagccggaggccactcgtattaggactgtatacaaaaaggcccagaaacttaacaagaaaaaaatagattttttcatcaccttagaaagatattgaaaattcattcacttctttgcagtcagagggtgacttctggcagctgacaagtctcggatctaactgcaatataaaaagatttgtggagtgagagagtgcctcccactgctttctaccagtcaataaatttgtcagtcctctgaaagctttcagagagaaaacgttcacaatatttgtgttttggttcagacctgctcctataaaggccccgtggcccagccttgttactttcagctgcaagaggcagcagctgagcccagtgcaggggctctgagtcacctggggaacttgccgcccccagacagccgggcccctgtgcagagtgtgtgactcagtatgtctggggtggggcctgagagtctgcatttctaacgaatccccaggtgctgctgagtggctgggcccagagtggccttggagaagccctggcatgattgcttgtgccatcaggctgcctagttctgccccttatgggcagggcgaccttgggtcagggctggcttctccaagcctgcatctcagttccataaagtcagaacagcaccttcctttcctaggtgttctgacgaggggagtcttcagagtgtgggctctggagtcggacagcctgggtccaaaccctggctcctcacctgaaaagggtgtcctcttgggccagtgggctccttcagcaccctaggtaacatagccctgaaatgaaaatcataatccataataatgcctatttcatagaattataatggggattaagtaaattaatattttaaagtcttcagtgtttggttaataacaagtactatgtgaatgtaaaataaaataaatatgtgcaacacatccatcaatgcatggcaccattacgagccctcaacaaagagtggttactatttttggattcattggtacatggttccattaatcaataaatatttagcgtcaagtttctacaaggttctggtgtaggcattgaaagaagcacaagatctggtttcccttgtcttaaagattataattttgtgggcagacaacataaaacagagttcagtaacaggagtttctggagagtgctaccagcacggttcacagagcagtgggccagtatcattttttgggagagatcctcaggcagtggagtgacaggagaaggtttcagaatgttcagactcaagttgggcctggagcattttaggctgaaaggactgagaagaatgatgcttcagggagtttgctgctgttgcacgtgattttcttgggctggttcagccttcttcaaaggccatgttccaaaatcagcttcagttctttaagtaaattctcaatgagatcgtttttgcatgagcatcaaaaactgttgacctagcgaagaaaatgtgcatctacttccccaggatagggcggtggcccctcgaaccccatcacacacacagacctcatctgtccaggtaaatgagattctcaatgagatcatttttgcatgagcatcaaaagctgttgacctagcgaagaaaatgtgcatctacttccccaggatagggcggtggcccctcgaaccccatcacacacacagacctcatctgtccaggtaaatgagatgcccagagaccttcccatcagacagaccacagtccagcccttgcccaagggctcagatatgacagcaaacacttaaccctccacccttgccatcaccatcactcatccccatcaccccccatctgcctggatttgtctccactcaccaaaatagcccagagatacggcaggctttttggaggatctggttgacccatttcctatgatcctccaggatcctcctggagttcccaggtgaaggtcaggccgcaagaattaacctgcactctagagtcgaggaaccagccagagctcttccagtcttcctgtcccgctttgcacgctcaccacagactgggctttccaggcctttctcctctgcctctcatcaacagcccccttgtgctgataaccacgcaggctgtggtccagtgctgtgcccaggtttggtcagctttgtttagatctaagcctataccttttttaaagtataacccaacgctacctagtttaatttgtccaaaatgccaagtgatttctccacgtgttttgattttgaaagctgaacatccttatccataggcattttaatttggagagttggagagtgtcatgagctttgtcatttgctagggtgagggtgatccaggctgagccgccaggctgagtgcactgtgaattagcgtggtgtgcggggagttactggagtagtccctgactgccatatcattgcttcactcaccagatcatgcatcttcccatcattgcttctgttgatttatcctcatttctatggctgccacctgtgaaaggttcataaatctccagactgcatcgggctctaccttcattgggccagaaaaaaattcaaacccacaaagttattccttggaaaatgtagaggtgagatctcctccagaaacaagcatgctgatagttgaatgtggcacatgagatgtcactcactatccatctgccatcaccttatacaaatgcaggcacgtctcatctcattgcacttcactgtattctgctttgcacatattgggttttttacaaattgaaggtttgtagcaaccctgctttgagcaggtctgttgggaccatttttccatcacatgttcactttgcatctctgtcacattttggcaattctcacaatattttgaactttttcattaccattatatctgttatggttatctgggattagtgatctttgatgttactgatgtaattgttttgggagccactaactgtgcctatataaggtggcaaacgtaataaacattgtgtgttctgactgctccacaaacaggccatttccctcacctcctcttgggcctccctattccttgacacacaatattgaattaggccaataatatcttataaaatggcctgtaagtgttcataaatggaagaattgcaggtctctcactttaaatcaaaagctagaaatgagtaagcttaatgaggaaggcatgtcaaaagcaccacgataggctgaaagccaggcctcttgtgccaaatagttagccaaattgtgaaggcaaaggaaaagtctttgaagaaaattaaaattgctgctccagtgaacatgtgaatgataggtaagggaaacagcctggttgctgatatggagaaaggtttcatgctctggataaaagatcaaaccagatacagtattccctgaagccaaagcctaatccagaacaagatcctaactctcttcaattctgtgaaggccaagggaggtaacgaggctatagaagaaaagttggaagctaacagagggtggttcatgaggcttaaggaaagaagtcgtctccataacataaaagtgcaaggtgaagcagcaagtgctgatggagaagctgcagtaagttattcagaagatccagctaagatcattgatgaagatggctacaccaaacaacagatttttagtgaagacaaaacagccttcttctggaagatgatgccatctaggactttcatagctagagaggaaaattcaatgcctggctttaaagcttcaaaggacaggctgactctcttcttaggggttgaagtagctggtgactttaagtcggagccagtgctcatttaccattctgaaaatcctagggcccttaagagtgatgttaagtctactccgcctatgctctgtaaatgcaataacaaggcctggattatagcacaactgtttataccattgtgtaatgaatattttaatcccactgttgagacctactgctcagaaagaaagatttcctttaagatattactgttcaatcccagtatgcctggtcacccaaggactctgaaggagatgcacaaggagataaatgttgtttctatgcctgcccacataacatccattttgcagcacatgaatcatggagtcatttagactttcaaatcttataatttaagaaatacatttcatggctggcatggcggctcatgcctgtaatcccagcactttgggaggccgaggcaggcagattacctggggtcaggagttcgagaccagcctggccaacatggcaaaaccccatctctactaaaaatacaaaaattagccaggcatgatggtgggtgcctgtaatcttagctactagggaggctgaggcaggagaatcacttgaacccaggaggcagagattgcattgagccaagatcatgccatggcactccagcctgagcaacagtgagacactctgtctcaaaaaaaaaaaaaaaaagaaaagaaatacatttcataggctgggcatggtggctcacgcctgtacttgcagcactttagaaggccaaagcgggcagatcatgaggtcaggaatcgacaccatcctggctaacaccgtgaaaccccgtctctactaaaaaatacaaaaaattagcagggcgtggtggtgggagcctgtagtcccacctactcagggggctgaggcaggagaatggcatgaacctgggaggcggagcttgcagtgagccaagatcgcgccactgcgctccagcctgggtgacagagcgagactctgtctcaaaaaaaaaaaaaagaaaaatacgtttcataaagctatagctgccatagatagtgattcctctgatggatctgggcaaagtacattgaaagccttctggaaaggatttatcatcccagatgccattaagaacattcatatgcattagaggaggccaaaatatcaacattaccaggagtttaaatgaagttgattctaaccctcataatctttgagagattcaagacttcagtggggaaagtcactgcagatgtgataaaaacagcaagataactagaattagaagtagagcctgaagatgtgactgagttgctacagtctcaggataaaacttgaatgggtgagaagttgcttctaggaacgagcaaagaaagtgtttcttgagatgaaatatactcctggtgaagatgctaagaatattgtggaaatgacaacagaggatttagaatattccataaacatagttgagaaagaagcagcagggtttgaaaggactgacttcaattttgaaggaaattctgatgtgggtaaaatgcaatcaaataggattgggtgctacaggaaagcttttgtgaaaggaagaatcaatcaatgtgcaaacttcattattgtcttattttaagaaattaccagttatcccaaccttcagcaaccagcccctgatcagtcagcagccatcaacatcaaggcaacaccacctgccagcaaaaagacgatgactcaccgaaggcttagatgattgttagcattttttagcaacaaaacatttttaataactcacatacatttttagacataatacttttgcacagttactaatctacagcagagtataaacataacttttatatgcagttggaaaccaaaagatttctgtgactccctttattgtgatattcactttattgtggtggttggtggtctgggactgaacctgccaaatctttgtggcatgcctgtatatggctttctgtttttatctttgagatagagtcttgctatattgtcgaggctgggtctcaaactcctcaagcaattattgtgcctcagcctccagagtagctgagattacaagcacacgccattgatgtgtatgtgtttaagcatggatgaaccagacaaggagctcctccagggcaaagaccatcattattcagaaacctggtacaaggaaaagctcagggagaggagagggggagaagggagggcatagaaaatattgtaactgtagccaaagaagtggatatatttgtcaggattttttagtgataaaagacaaaatgtcaagttaaactagactaaacaaaaaggggaatgtcttacttacctgggatgatcagaagtgggtttggcatccagggactcagacagcatcctggggcatgtctctgcctccatccttatctcctgctattttcctttcctgctttcccttttctgtagtctctcttcagctctacttctttctgcgtgttcatctcgctctcttccagtgcaaaacgtcttccatatggccaggaagacaaatcacccctgggaccctgaggtctgtatcattccagtgccaggacccagaggcaagaagcagtagactctgaagctccaggaaaggcatgagaatacctgacccacccagggtgtgtcagaggccatcactcagggcccatggctggggtggcagggatggaatcctgcagatttacatgcctgagtggtatgcccattgtgggggccagggctcccagacagcccctgagtcacaggcataggggagagatggcctcaaactaggcaaacaaaaagtggaggtcaccactacagcagttagccagaacatgtgaaagtaaaacataggcaaatactatcttaagtcattaatccagtgaatatgatcttctatttgttggtagaatagagcaactgtagctgagctagtgattacagcaacatctgatcaatgctttcaactcagacaaagtggccagtttcctgcgtagaagggttggaaggcctgtgaaggccactgttgttccccatctggcccatcctgcagatgtcccccctctactcggcccctatgcagcaatgagggcggtcatggaaaacaaaattctcaccttctcccttgtttggaatgtcctggaaccatgatgacaaccagcgcccttcagtgactcccattgttctcacacaaaagcatggagtcaggagtgtaacttctaggatcctgcgtcccctgccacttctccagcttatcctctcaccgcctgccttggcccagctgctgtggcctcctcccttcctcggaggattgtcctttcttgccttgcccagggcctcggtgaacgtggctccctctcctgcgatgctctcattccccttctttccctgggtagcctctgctcacccgtagatctcagctcagatatgattctcagggcagacctcacaaccacccagacaagaccctcagggtgccctgttggcactttttaaacttcctcccagcaattcccagactggagaatgtcaggatgcctggccaggccactcctagtcagcccctggaggctcagtgactccctgtgaggagggggagtttatgaaatgcacagccttgggcagggcctgatgctggttcctgtcactgttgtgcccacctctccatgtccctggactcattagaagggtgccatctcttcagtcagctaggaacttctggagctcctctgttacactaaatagcttcaagtggacactgaacacgtactatcaaatgcttaaaagcacaattttattttgagaactttttctcagctttggaaaaataatacctcagaattctccaggttaaaatgtgggttcaggaggtgagaaagatcccaagagatttctctgggtgggtgactctgaaaaggaaggttttcctttagcgtttgaaagctgcattgatgggaaggtctttagagtggtgttggggcttttcatcttgattttggttgatgttttgaaagaaggaatgatatgagtactttctggtaggaagagcaattttagattatctacaagcatttctctttcttggcactacactctgccctttggcattaaatcctgaagtaatttgctggagtggaaaatgatgtaatacattatactggtttttgaaggaaagggcagaggggaaaagtggtaaagtgagggaactacaagaatcctgtgattaaaatgcggtcctctgtggtaaggattggataggttgatgacacttattatgctaataatatgttacctttgaaagtgttttataacctccaggattttctcccataaattatctgctttcatcctccccacagcaccatgaggcaagcacggcaggtgtaattatctgtattttgtggataagaaaatcaaaatgcagagcagttaaatgattttttttgccatatcctagagctgcctaggcaagaaccaatgaaagaaccaagcattctggattttaggctgatgggttaatcatcagcctaaaatatgaaatactcactcagaataaacagttatagccattgcaaaaatgagatgagcccttgcatgccaactgctcagcacctcgccaggtccatcggacatgccccgagggtgtttgtggtgttgatgatgatgatgctgaactaaatgagaatcatcaggaatcttaaacctctcattgatcaacagctttgacatctcctctgtattagtctgttaccacgctgctaataaagagatacctgagactgggtaatttataaaggaaaaaaggtttgattgactcacagttcctcgtggctgaggagacctcacaatcatggcagaaggtaaaggagaaatgaaagcacgtcctacatagcagcagacaggagagaatgagacccgagcaaaaagggagaccccttataaaaccatcagatctcccaacatgtgggaattatgggaactacaattcaagatgagatttgggtagggacacagccaaaccatgtcatcctctatccatccgttacaagccagtataacaaaaggttgtgtatttgcccagctgagcagtgaaaagggaaaaggccaaaatatagggaatgtgagggcaaaatagagtcagtatttagtaactcacagattgaatgttgtgttcctgaaatagagcattgggtactctgagaatgactcctggcaattttaggactacttccatgggaaaaagcacataaccacgtgtatacatacatatgttattaaccttttagctcaaaggtaactgggctttccactaccatcagtttctgtatacaaggcttgaaggccaattatactttatttccagcagtctcttcatgtaatctctgcaagaaaagtctcttttgataggatttgccgactttttcttcagtgttcacctatgctcccgtcaggtgagcacactgcattcttagcagtgctgggtgtcattagtgttcagtctttcataatctgataaacaaaacattgtaataagatttctttttgttattttttagcaatttgtacagttctttgatcgatctgtttgtgtccttcatacacatatttatagctcagtgatcatgattcatgctttccacttgtcggaatttatcccagggaaatatcagagacacaggtgaaaatttttgtgccaagatgcacacaatagtattttattacgataaaaaaaccaaaagactgtatgtcaaataataagggattaattaaataaactgtcatatctcttcaagggcatgtctcaaagaatgtttaataacatggaaaagcatccaggtgtggtggctcatgcctgtaatcccagcactttaggaggcagagacagacggaatacctgaggtcaggagttcgagaccagcctggccaccatggtgaaaccctgtctctactaaaaatacaaaaatcagctgggcatggtggcacatgtctgtaatcccagctactcaggaggctgaggcaagagaattgcttgagcccaggagacagaggttgcagtgagccaagatcatgccactgcagtccagcctcaccgacagagcaagactctgtctcaaaaaataaataaaaataaaataacgttgaaaagcattcctaatataaattaaccattatattatatggccttagttttattaaaaaccagatttatacctctcctaccaacacacatacatcttgaaggaaatgaaatacaacaaagttgatttgtgtatgttttgtagagacaggatctcactctgtggtccaggcaggagttcactgcagtcttgacctgctggactcaagcaatcctcctgcttctgtgtctcaagtagctaggactacaggcgtgtgctatgacactcagctaattttttaatgttttgttgttgttgttgttgttgttgtcgttgctatttgtttttgtagagatggagtcttaccgtgttgcacaggctggtctcaaactcctggcctcaagtaatcctcccaccttggcctcccaaagtgctaggattacaggcaggagccaccatgctcagctcgaagtttattttaaggtggtattttgtatatgtgtgagtgtgatctgtaagacaacgacatttttcttttttttttttttcaaatattccacaaaaaacaaatacttgtagtcacagtttggtggcttttgctgtgctgttttccagcttgtaactggccagactgattctatgatctcaagccagcggttcacttttcaaaaaaacccaacactcctttacccagccccatctttgttgttggtatatctctctcgcttcttcttattactttgtagtaattttacttcagaaaagactcagaattcccaccatcatccagtttctgacatgaacccatggaaggcatactgttcaggaaggttggcctatgtcaggggcctgacacctgctttgaagcacccatcaggggccatgtgtggaccaagcatacattccggctctgcctgagtccacattcagcatcacctggactcagtaggatctggggcagcaacggtcagccagcagggtgacgtcacacatgtgcacctctcctgcagtattcaatgctgctgtccccccaaccacacaggagctgccttctcccccagcactgctgccagatgacagcttggtgcagggagcaggacatccacaagtgggtgtggaatcttccctgcccgatgcctctcaggagccaggggcatggcttcagggccccaccaggaatgtgcacgagggtcaccagactgggagaagtggcagctgtaactccctcccagtactcatggttctccttatctcaatgcaacttatcataaataatgctgtcatgaatagaggtaatattcaacccttatcaggtttccagggcaacaaaagcaggaagtcagctgatggtcaaattcgctgcaaagaggactcaccttaggttctgagtgccagagtgtttcttcaatctttcagacacagctggtaatcctaacttgctgttatatggcctattgatgaaaccactcgggaccacatgtggcatttgtagcacacccagaaattaaacccatgcagagaaacgagctcaccaggactccttaggttgtccttggagggcttcctcacctcacttgctagcagccactgcccaaggacctgctgtgttctctggtcagctttctgctttcagcagggtcttctaaaaggtacgtctacaaggttgcagatttggaggaagaattcctgtatcctggtgaagtgttttgtgtgtgtagagtgttccagtgacaggagttatttgcaggattggcacagtctccagtgaagactctcctgtgggcttcaggagcagtaacttgcgtatgatcattgctaaaccaatggggatagccagttccatggccagccaacctgttctgtgcttcgccctataaattatgttctatattacatacaacaggatctttcacttttatttactacagaaatgtcagtaaatggttcctgatgtaattagcttgatcaggaaatgtgataactcaagagaagccgtggaatagagagagaaatgcaattgccaaatagtcactactatgtggatatgtccttgacattaggaaagccgctataatgtgtcaattaaagaaacctaggcaatgtgataattgaagtttttaattgatatagagagagaatctatttcccccttaataataacatgttgggttcactatgaatgtttaatttcctttccatgataaatagttttccctagtctgggcatggtggcccacacatatgggaggccaaggcaggaggattgcttgaggccaggagtctgagaccagcctgggcaacagagcaagacccccatcttaatttaagaacaaataataaataaataaatagttctccttttcaacagaagtttggtaatataactaattaatttgctgaatatcttttactgatgtaaatatgaatgtaactattgaatttgacaaagtgaaaaatgaaagaaatctcttagagatcatccaacccaacctctaatgttatagtgaaggaaattgcattaaacagtgttgaataacctgctcacagctggacagctagtagtttcagactggaattcagggttccatttcaagtccaaggttctttcttttttatcatctcacccttagtagtattgctatcattttgtcaaatactgagctatgcaacatgtttcccttttggccttgattttccagaactaaaaaccaaatcgtgcctgattatagtaattattccatccctagttcctgatgtaattagccccctctttagctatttgtgtctcttttatcataaccattctgggaacatgcagattgtgcttttattgtaatttactttgaattggtttaagaaatattaagggtgtaaattgtcacttaatacacacacacacacacacacacacactcttcttctcagtaagttacctggaagttgtactaatcttttaatttctctttttaaattatcttagtgatgtaaatattcatgaaacttttggatttatttgacttttggaaaagtcaaataaagcctcaattagttaaaacccagccaactcacatgctaaaccttgggatagttttcctgtatacaacatacatggaaaagaatagcaataacacagataatatcaaggaaaacagtttctgggaatagatgtatatttgatctaatccatttttgtacatgcacaccaatagttttggacaatgaaaactgattatcttagtcaataataattccatattgtatacctcattctatctaataaatcaagaaagtataaagtctgaaaatatttccctaataaggactgaaattgaaaagatctcttctttagttagaaaattcaccaagaaagtgtatttaactgaaacttcccaatcctctagagaattccagtgtattagtccattctcatgctgctatgaagaaatacccaagactgggtaatttataaaggaaagaggtttaattgattcagttctgcatggctggggaggcctcaagaaacttacaatcatggcagaagacacctcttcacagggtggcagaagagagaatgaatgcccagcaaaggggaaagccccttagaaaaccatcagatctcatgagaaccagctcactatcagcataacaggataggggaaaacaccccatgattcaattatctctacctggtccgtctgaagacacatgggagttataggaactacagttcaggatgagatatgggtggggacacagccaaaccatatcattctgcctctggcccctcccaaatctcatgtcctcacaattcaaaacaaaatcatgcccttccaaaagtcccccaaagtcttcttccagcattaactcaaaagtccaagtccaaagtctcatctgagacaaggcaagtcccttttgcctatgagcctgtaaaatcaaaagcaagttagttacttcctagatacaatgggggtacaggcattgggtaaatatacccattccaaatggcagaaattggccaaaacaaagaggctgcaagccccatgcatgtccaaaatccaatagggcagtcattaaaccttaaagttccaaaaatgtgtttcacgtctaggtcatgctgatgcaacaagtgagcgcccatgggggcagctctgcccttgtggctttacagggtacagcctacctcccagctgctttcatgggctgacattgtctgtggcctttccaggtacctggggcaagctattggtggatctaccattctgggatctgaaggatggtggccctcttctcacagttccactatgcagtgccccactggggactctgtgtgggggctctgaccccacatttcccttctgcactgccctagtgaggttctccaggagggccccacctctgcagcaaacttctacctggacatcctggcatttccatacatcttctgaaatctaggtggaggttcccaaacctcaattcttgacttctatgcacctgcaggcccaacatcacatggaatttgccaagatttggggcttgcaccctctgaagcaatggcccaagctgtacgttggccccttttagcgatggctggagtggctgggacacagggcaccaagtcccaagtctgcacacagcagaggggccctgggtccaggccaggaaaactatttttccctcctaggtctccagacctgtgatgggaggggctgccatgaaggtctctgacatgccctggggacattttccctattgtcttggtgattaacattgggttccttgttacttatgcaaatttctgcagccaacttgaatttcttcccagaaagtgggattttcttttctatcgcatcatcagatggcaaattttctaaacttttattctctgcttcttcctgaacactttgttatttacaaatttcttcctctagatactttaaatcatttctctcaaatttgaagttccacagatctctggggcagaggcaaaatgccaccagtctttttgcatagcaagagtgatctttacttcagttcccaacaagttccttatcttcatctgagaccacctcagcctggacttcaatatcagcattttcatcaaagctattcgacaagtctctagtgagttccaaactttcccacatcttcctgtcttctgagccctctaatctgtaggaagttctaaactttcccacattttcctgtcttcttctgagcccttcaacccgttccaacctctgcctgttacccagttccaaagtagcttccacattttgggatatctttatagcagcacctcactctccgtagcaccaatttattgtattagtctgttctcacactgctatgaagaaatacctgagactgggtagtttataaaagaaggaggtttaattgactcacggttctgcatggctagggaggcctcaggaaacttacaatcatggtggaacctcttcgcagggcagcaggagagggaatgagtgcccagcaaagggaaaagccctttataaaaccatcaggtcttgtgagaactaactcactatcatgagaactggatgggggaaactgccccatgattcaattatctccacctggtccctcccaagacacatgagaattatgggagctacaattcaagatgagatttgggtggagacacagccaaaccatatcatccagttaattgaaccttcacagaatttactataaccttgagtgtataagccatatttatgctaaaatgttcatttttaaaaatgaaactaatgaaaatgtcatgtattttgtaaatacccagagggggcttgcccaaggtagactgagtgggcttacttgggaaataacaaagagatgagtctggcagaaagaaattgaggatgagaaataacttgggataggctagtgatggctttgaatcccaagcagaggccctcacacttttacctggtaggctcagaagaagaaggactaatatgataactattttattttattttatcttatcttattttattttattttattttttgagatggagtttcactcttgttgcccaggctggagtgccatggcacggtctcaactcactgcaacctctgcctcccaggttcaagtgaatctcctgccttagcctcccaagtaactgggattacaggcacctgccaccatacctggctaatttttgtattttttaagtagagatgggttttcacctggttggccaggctggtctcgaactcctaacatcagatgatccacctgcctaggcctcccaaagtgctgggattacaggcatgagccactgcacccagccaggataacattttataaaaaggaatatttgttgagctaatgtacattgaggcctactttaatttcaatatacttttcagacaaggaatcacacacttgtacaattttccgaccttatcattggaacacttgctaatatgatgcagatgaagtgggattgtgataggctattttaagtacttgaattatgagacaattttcgactgcagtagcccaaatggtaccctgcagccgtcaaatgtgaggaacttcagtgtgagtgctgacaccaaatggaacctcatccacccacctgatgaaaattgatgttcccctggctgtcaccctcagctgtacgctttgctcaagaagtactttgttttgagggactttatgttgtataaaatatggttttgcctgtcatccataggtgatgaacctgccatctctgtctcctgtctctctttaaacactaacttccagttgcctatggagcaactacctggaagtctcagaggcatctcacagtcaacctgcccaaactccactctgacttccttctccaaaccttctcttccttcttcatttcccatcttaattcttagtaacccgtacattctgtcacctaggtgtgaggatgagaaatcatatttatttccttctgttcccgccacacacccacaccctgtagattctgaatcctaatatttttcaaatccatcttcttttagatctcatttttgtagtttgtgctttcactatttcttaggcctccccacctccagacttctgcctcccatctcccctcagccgtcatggtgatatttctgaaatgaaaatctgattttctggctcttctatgactttgctttccaagtttacccatcacaaagaaaatgaagccccaacttccctggaacacaaggcttctcccacctggaacacaaggcttcccatagcctgacctgtcccccactcttgctgtgtcttttaccaccctgcatccctacccacttactattttacagctcttaccacctacttgtagtcccctaaatgcatcagatctgtgagcctttccacacatggatgctgacatctgaagagttctcccttcaactctctcccatgcacaccgaatgaattctccaggcccctcctctaaagcgttccttcttcacccccagctatagtttactgcccctttatattatatgctgctcctggatgtgggacagcaggtgcatgcctgatcaaatgtggtatctttaatgatcaacaaatgtcaggtaaacagatgcatgggttagttggttccagacatagaatttactcaaaaagagagcattttttttttctcctgaatggttttcaagatagctcaatatattatgccatttttaaaattttattttctttttagattacacataataattgtacttatttaatgtggtacagtgtgatttttgtttgtttgtttgttgttattgttgctgttttttgagacacagtcttgctctgttgcccaggctgcagtgcagttgtgggatctcagctcactgcaacctcagcctcccaggttcaagcgattctcctgcctcagcctcccaagtaactgggattacaggcgtgcaccacaacgcacagctaattttgtatttttagtagagacagagtttcttcatgttggtcaggctggtcttgaactcctgacctcgtgatctgcccacctcagcctcccaaagtgctgggattacaggtgtgagccaccacacccagataagtgtgatgtttcaatacatgtatacaatgtgtaattatcaaattacagtaattagcagattcatcagctcgaacatttatcatttatttgtggtaagaacacacaaaatcttctcttctagatattttgaatagacaatatattattgttaaccattattacccaactgtgtaatggaatactcggacttattccttctacctcattgtaacattgaccagtctctccccattacccacttgcacacaaacacacacacacacacacacgcacccttcccagcaccttcccagcaccgttctactctctacttctatgagagcaatgttttagatgccacatatgagtgagactatgtgacatttggctttttgtacctggcttatttcacttaacctagtgtcctctaggttcatccatgctgctgcaaatgacaggatttcattcttttctttggctaaatactatttccttgtatacatgcataccacattttctacattcattcatccatcgatggacacttgggttgattccatgtcttgcctgttgtgaatagtgctgcagtgaacatggaagtgcacgtatctcagcttactgatttcatttgctttggatgtctacccagtatacaaccatatgattgctggatcatatagtagctctatttttcattttttaaggaacctccatacttgtttccctaatggttatagtaatttacatttccaccaacagtgtataaaaggcccccccttatccatatcctcaccagcatttgttaatttttgtctttctgataacagccattctaacgggggtgagatggtatgtcattgttgttttcatttgcatttctctgatgattagtgatgttgaagattttctcctagacctgtttgccatctgtatgtcttcttttggaaaatgtctattcagttcttttgcccattttttaatcaaatgatttggtttttgctattgagttgtttgagttccttatgtattatggatactaacccctcgtcagatgcgtcgtttgcagatatttcctcccattctgcaggctgtctcttcactctgtcgattgtttcttttgctgtgtgaagctttttagtttactgtaatcgcctttttctatttttgtgtttgtgcctgtgcctttgagttcttttctataaaatccttgcccagactaatgacacgaagtatttccactgtgctttcttcttgttgttttataactttgggtcttatggctaagtctttaaaccattttgagttgatttttttaagaggtgagaaattggggtctaatttcattcttcacgtcaagattactttgaataaaacttctaaatgaaaattttaaaagttcagccctttgctctgagtttttgtctctattctactcccacaccccccccaactttagtcactgtggaacccacagtgaggtcctctttaaagctggcttgcctgggttttagacttcctcctccttttttttttttttttttttttgagactgagttttgctcttgttgcccaggctggagtgcagtggcatgagctcagctcactgcaacctccacctcccagattcaagtgattctccagcctcagtgtcccaagtagctgggattacaggcacccaccaccatgcctggctaaattttgtgtttttagtagagacaggttttcactgtgttggccaggctggtctcaaacttctgacctcaggtgatccacccgcctcggcctcccaaagtgagtcttcctcttctttaagatctttatctctctgcctttgggtcacatctaggaaatgattcatccccccactgctcagaagcaccactcttcttgtgtctgaacatcttgggactttctaggttttaccccattgctctttcaaaaattccagatattctactttccatatgttttctttttggttgtgaatcagagagtggtagccttctcccatcgcttatgactccttctctcttgttcttcaaactcgagtacagaggctactgtggcggcgtgtttgggtgattgatgggcttcctacacttggatgttatctatgccgggcttgtcttggttacatcccagcctctccagagcaatgatgttctgctgggatctgggggctccaaagtgggctgtatgggctggggatgccagcaaatcttccatccttccatttgcttgaaattaaagatacacagaagtaatgtggccacgggggtggaaggaagggaggatggaactcaaagggaaaatgacatgtggaccctgctctcataaaatttgaaatctagtcagtggagaagaccagatgatcccacaggagaaatctggggtgtcaagtatggatacacagtgggaatgattcatgtgactcactctgctgaggaatttgcccactgccctgacacagacctcactctactggtgaggtctgcagaggctactgaatatttgtaaagagtcgagtctgcacagttggcttccagcaggcattggacagggccctccgtggaggccaggcacccggcatgcagttcccctgcctcccttggcctggagtcactgctcttctccgcaggtcactgcccccatcagctgtggtggtctagtgttcagcagaaatgggaaacggagtcttctgaggctgtgccgattgtcattgctctgaaaagagctcacttgtgcttgagtggacattgcttcagcatcaacgtgaaggcctctgtctgtgggtttcagggggtgccagggaccagactggagagcaggcctcatcctgcgcccacgtccaacctcccttatcctctcccccatgctcctgcatctgcttcccagaacctctcggcctgtaggatctgttctgttggtgaggagggagtacagcataaacacagaaggtctgtgacggagagagattgttgaggcttcctgctggaaggttgagagctgagcagaggcttacaagagggcaggatctggatagatgccaacgaaaacagagcatttgggtgaggagaagagtgaatcgatggactgaggagggaacacacctgtgctatgcccaggagaggaggcaccagcaggcagagcttccaggcagggcgccagggcagggcagcatggaggaagtggagacagtggccttgcctgtcctggaaaagcctgcgagtgtccccatcacttactagtgggggctggatagtcacacatgaggaccacaaagcagatgttatcattctcctgggccttatgtacatctcagtatgtttgggagacctgagcatttaccttgtaaaagttttctggaagaaggaaccaaggtttgatggcagagagtacatgccctgctccaggatggcagagagcacatgccccgctccagcatgtcagagagcacatgccccactccaggatggcagggccccccggctgcagcatggcaggggttccagtggacagtgggcttgggtgtttcaacagcatctcccactgcagggccccagtgccacagttgggttgaggccacagaatccattgcagatgcaggtactggctgagtgcccacagggcaaaggccatcctgaaaaaggggtgggcagccccttcaccagaacggaatgcaagtgctgagccagctgacagggtccttgactgatgggtctttcagtgagaagggtctcctgccagtgtgggcctgcagtcaccgggcagctgacgacaaaactcccagcaagaggtctttccccaataagcctcgagaagagggcagaatggggccagctgctgacgcagctgccatgtctgctggagacatgctgtgacaatgacagggaggcatccttccgtccccacctggttcttctgtatgggtctcatgagtgtgagcttctgacatcaggttccttctgagtgaggaagagaatgtgagaggtggcatcctgattaaagctgtttatggtctggtgcatttttggttaaaaatcacacttttcatttatttagcacattgctgtcaagttgcaacacgctgtaattatcagaccacaagttctggaacctgctgcgtaaggtccaatcctggctcctccttccgctaactgctgaccttgggcaaggcatttaactgcctcgtacaacctggtttcaatcccagccgcacccctgacccaccagctgctgggcaagttgcttaacagctctgtgctcctgtgtcttcatctacaaagcaggaatgatagtacctgccccatagggttatttttaaagattaagcgagttaatgctcataaagcactttcgaagtgtctgcccaacatatacaaaaatttacccgaaatacatcaaagacctaaatataagtgaaaactgtaaaaatcatagaagcgtaagggaaatgttcatgaccttggatttggcaatggatttttagctgtgacaccaaaagcataaaaaataaaagaaaaaataaaaagaagtagataagctagacctgatcataattaaaagcattaatccttaacattctagctcacatgacacctcctctgaagcctgttctaaccccttcagagagaatggattttttataagggagacagtaacagcaacagatgtgactgagcatttacttcattcaggccagccactgttttacgtactttgagttggttgactcacttgctcttcacatccatttaagattagattctattggccatgcacagtggctcacacctctaatcccaacacttgtgaagccaaggcaggaggatcacttgaggccaggagttcaagaccagcctaggcaacatagtgagaccccatctctaccaaaaaaaaaaaaaaaagatacagatagatagatatatagatagatgcctggccgtggtggtgtgtgcctgtggtcccagctacctgggaggctgaggcaggaggattgcttgagcccaggaggttgaggctgcagtgagctatgatcacaccactgcactccagcctgcacaacagagaaagaccctgccttccaaaaacaacaacaacaaaagatgaggttttattattatctctgctgacaaatggagaaactgaggcagataacagtccagcagctggcccaggccatgcagcacatcctctgtgctcccagcacgtgttgcagacaccatcgtgtagtctggagcacactgagctggttagatccagattcccactgtgaatgggaactccttagggccaatgacatccctaaccctgaatcatgggacctcaatgacttctgcaggactgaaagttacatcttgattctggagggatttgggtcgcagactagagatttaaactttattctgaagtaagcagaaagttatttcagatttttaaaaaatacatgagaaaaatcgtgtttcagtaaagacaaatctggtgtgcaacgtatgagataaatcaggggcggcagcaggaggcagggagttgagtgagggtggcccacggttgtgagtggctccaggtgggtggggtgaggccttggggatggtgcgtggactaatccagatagtgaaggccacacgtagggaggcttcaagtccctttaggaacaagaatctcaggaactcagaggagcctgagtgctctgccagccatgcacatggtggataaaaagtaaaaattcagtcactcacccaatatttgatctcagcatccaggatttctcagcctcttgggggttagcatcgcaaaaccacaggcagaacttgatgccttccatcttcttttcttcagatatcttaatctgaatatcaaaaggagaatgtgaggcacagtggcttatgcctgtaatcccagcactttgggaggctgaggtgggtggatcacttgggctcaggagtttgagaccagcctgggcatcatggcaaaaccccatctacaaaaaatacaaaaattagccaggagtggtggctggcatctgtagtcccagctacttgggaggctcagtgggaggattgcttaagcccaggaaacaggtttacagtgagctgagactgagccactgcactccagcctgggtgacagagcaagactcctttctctcaaaaaaaggaaaatgtgaaagatcttcaaagcaaaatacactcttctttatagcttgttctttcattttccttccattagaaataaaaccaaagcaaaaaaagaggatttaatatccatcatagcaaactttactaactgaaaataataattggctatggtctgatttgattcaaaaatccattgtaggcttacaacacatttatttttaaaaaaaaaaaaagctaaaacttagtaatacatcttacccttaggcaaactcataagaacagctgctgaaattaaattaggttgtatacttgtttctggaagttttccacctcatttctggctgaagtgaatccttgaagaaccaggagggctgagcagaaaacaaatatttgccactgctttcagatccatccctctgtgggaacaatctggagaaactgcctttttcatattttcagtaaaaaaaattccatattcatgccatttcctgtattatgcaaaataccttccctccatagtctcttaaatgacactgcaatatttttcctagaatttcctaaaagaaaacagctggtttgatccccactcttggtccgcatgcctgatttctgtagacactgggtatttgcagtctgggctgcatcagtttgtgaggtacccataaggatgtgggcagagagtttagagacagaaaacccagggcagaattgatccatgcaccagaaaatgcattgtgtaggacaatttatagcttaggagcttcaggagacatgaggtggttcctgggtcacaggttctcaaatttggctgcatattgtaatcacctgggatgtttctttaaaatgctgatgcctggattccattcctagagattctgactttgggttggtctggtggattgtgcattaggtttttcaaaagctccccaggccatgtaatatgtatcaaaatctgaggaccaccaacatagaccatctccccctcctccccagagagggggcgacttgcccaaggtcagaattataatatcttccagtgtaccccaactctgcagatggttctctatcacccagtggcccaagagatcagtttgagaacaactttgcctcatcccacaacttcaccccagacctcaggtcacttcccatggtcaatgggttcttctcatagtctcaatggctgatccttctccatctccatggttagtgctcctcagatgatagcaacaggctcctctcatttgaggcctggctcccttctcttcgccacaccatctgcctccatactcatcttcaggagacttgagtgtaaacatgttgcctcctactcacacctctgtcaggggcttcccattgcctttgggacaccttaatgtggcttccagaccctccaggagctggctcctggcctcctgagtatcccatcttgcccctcctgtatgattccgcttgtatgaggtccctggagttgtcagacccctagagacaggaagtagagtaggggtgccaggggctgggggagggatggggagttacaatagtatttaacggggacagagtttcagtctgggaagagggaaaggttctgcagatggatggtggtgatggttgcacaaaaatatgagcatacttaatgcactgaactggacacttaaaatggttaaaatggcaaattgtatgtaatgcatattttatcagaacagtaaatttttttcaatagctttctgagaaagaccttgcctgccctttgcctgagttaggcagctctgttttgtgtttccagaactccacaatcttcctatcagaccactgtcctgcttagagtctggcctttttacagattgtgactagaataaaggcgcattggagttctcgcctatttaccactgtgatcccccatgactgcagagtaggtgcccactgcataattgttaatgaatgttgttgaatgaataaaacccagaactacagtgtcccagcccgtcaatcttaattgctaggaaaaattggattgcaaaaataatccaatttgatattgtattagtccattcttacattgctctaaagaactacccaagactggatcatttataaagaaaagaggtttaattgacacactgttctgctggctgtacaggaagcatggctggagaggcctcagaaaacttttaatcattgtagaggggaagcaggcacatcttacatgggggagcaagagaaagagagtgaagggggagtgctatacacttttaaacagccagatctcatgagaattcactcactatcaagaagagcaaggggaaaatccacccccatgatccattcacctcccaccaggccccacctccaatattagggattacaatttgacatgagatttgggtggggtcacaaatccaaaccatatcattccactcctgtcccctcccagatctcatgtcctgctcccatttcaaaatacaatcatgccttcccaacaatctcccaaagtcttaactcattccagcattaacccaaaagtccaagtccaaagtcttatctgaggcaaggcaagttttttctgcctataagcctgtaaaatcaaaagcaagatagttccttccaaaatacaatggggacacaggcattgggtaaatactcccattccaaatgggagaaactggccaaaacaaagggctacaggccacatgcaagtctgaaacccagcagggcagtcattagatcttaaagctccaaaatgatctccattgactccatgactcatatccagtgcatgctgatacagcagtggtctccatgatcttgggccactctgccctgtagctctgcagggttcagcttcctcagctgctttcacagggtggcattgagtgcctggggcttttccagatgcatgctgcaagctgtcagtggatctaccattctagggtctggaagacagtggccctcttctcacagctccactaggcagtgccccagtggggtctctgtgtgaaggctccaaccccacatttcccctctgcactgccccagtagaggatctccatgagggcttcaccccacaacagacttctgcctggacttccaggcatttcatacatcctgaaatttaggtggatactcccaagcctcaactctcacactctgcacacccacaggcttaataccaagtggaagccaccaagacttggggcttgcaccctctgaagcaacagcctgagctgtaccttggcctcttttagccatggctggagctggtgtgggcgcaatgcagggcaccaaggctgcacagagaagtgggactctgagcccggcccatgaaaccattctttcctcctaggcctccaggcctgtgatgggaggggctgcctcaaagttctctgaaatgccttggaggcgttttccttattgtcttggtgattaatatttggttccttttacttatgcaaatttctgtagcaggcttgaattcctccctagaaagtgagtttttctcttctaccacatagtcggactgcaaattttccaaacttttatgctcagcttccctttttaaatataaattccagtttccaatcatctatttgctcatgcataacaaaagtgaccttggctgccattctcaataagttccttatctccatctgagaccatctcagcctggacttcattgtctatatcactatcagcattttggtcacaaccatccaacaattctctaggaagtttcaaactttccctcatctctctgtcttctgagtccttcaacctgttccaacctctgcctattaccaagttccagagtcacttccacattttcaggtatctttgtaagaatggccccttctcagtaccagttttctgtattcattcccacattgctctaaagaactacctgagacttggtaatttattttaaaaagaggtttaattgactcatgattctgcaggctacatagaaagcatggttggggaggcctcaggaaactttcaatcatggtggaaggtgaagggaagcaggcacaacttacatggctggaggaggaggaagagagcacagggggagggctacacacttttaaacagccaaatcttgtgagaactccctcactatcatgagaacagcaagggagaaatctagccccatgatccagtcacctcctaccaggctcagcctccaacattggagattacaatttgacatgagatttggacggggacacaaatccaaaccatatcagattttaagtagctagaagtatcagaccacaaattgtccagtcatggtaagtgataacattgggtgaagaatgtggaatttcagcctctgattaatccttacaggtatattctgttcgaggtgggtagacctccaagaattttgagactgcctttgttctgtctaataaatacaacaggaaaatgaaaacccggttgatgatttcagattttttaagaacagcctatttataaccacttccttgcttaatattatgcttttttctctttccaaattagatatttatttttgaaaacaatatctactactgtgcacatgtcgggaaacaggccatccgtgtggtctccactggcaaggaaggtgtgatttacaatggcctcagtgactggctgtatgaaggtaagatgtgcacagagagaaaaaaggaagatttgtggttgctgctgctgctacattggagttgggttctttttcatttttctttgactttaactgtaaattaaactccagtttcttgaggttctgcaaaatttaaaagattttgttagagcttttgggatcaggctgatcagcatcagagaacagcatcaggctgttgtcaggggcctgcagtgttgtgcactcacctgggacaggtgtgctggctttgggctttgcagagctctgcaattcatccctgaagggcaggaggctcgttaatgggagatttattatgtcaggaggtgacttctgggaacgctcagggactgcaaatgcatgtgtctctaccccactccaagacataagtgcctcgttttgccttgggaaggggacagttggaaaagaaagaatgagttgcatctttccaaataaatcatcagagtgacttgctgctgagagcgcctccaccttgctggacattttctaccactggtttgcctttggcaccagaagactcatgctgtatacattattaaataactagaagtcagagggggaagctctcttcttaaactttgataacctgtctccatgctcatgacccttcatcgtaacaataacaaccaggtattgattgctattagctgtcaggcactgctggaagcactttgttttctgttacttcattccaccctctgtcttagtttgttcaggctgctgtaacaagatataacaagattccacagactaggtagcttaaacaatgaatatgtatttctcacagctctgaagcctgggaagtccaagatcagggtgctggcagacccactgtctggtgagggctctcctcctcacttgtacatggctgtcttcttatgtcctcacctggcagagtagagagagctctggtctttttatctctttataagggcacaaatctttttatctttttatctctttataagggcatgaatcccattcataggggcaacaccctcataacctcatcaccttacaaaggctccacctcctaaccccatcaccttagggatttgggtttcaatatatgaatttggggggacacagacattcagttcatagtactgtcataacaaggttctattttatagatgaggcatggttaggttaaataattggcccaagtttacacaaggtaaggaatatttattggggaaaggcgttgtccaagctcagggtaattaccttttttgaattccacatgtggctacagtaaccgtatgctttccagcatggggctgatgaacaacccaagctcttctcagcctcctggcctgaaaccgtgtggtcacagcaataactcaccctgctaggctgggtcaagggagggtcagggagattctgggtgctttctcaagccagtatcactttctcctagtgctgtgcatgcctcattctgcattttagtggctttatgcatcataaattataaagcagatggatatgcaagcttagtgttacctcctaggataatttctctgaagccataaagttctatgacttgatttttaatttttgtaaatggaggtataatttgtacataataaaatgtacatcagaaggacagtttgatgagtttggcaaatgtatatactatatagccccagtcaagacatagaccatttccatcagtctagaatattcctacaagtccctttccaagggctttctccctaaatctgtcttccagagactgccacggtcctgggggctaagcagcccattctctaacagacatactggaacccaagcatccacatgaggctgtccttccctgtgtggtcaccatggaagccccatgtttattccaatgtggctgccggtgctcagagcatgctgaagagtccagtttccttctgagccccaggagaatcaaccctgagattttattgtcacatgagtccttggctacacctgaaaaagccactggaatgaaagaggggacacagtctgctgtagttatgcctgttctgtgcagaaacagccctagaaatggtgtgcccggagatgtccccagctccaccaaagaggtacaggcagcagcacaaagggaagctccggaggggctgcacctctgcctggggtgcaatccctgagcctctggggcttgcctgccccctggactcagtagactgttgacaatgaggactctaaagccccttgtgtgctgcccttttgtgagaaaaaggccttatacctaggagcaactggaaaactgggtcctgtttgctccctgatatctgagatcccactaacagctcttttgcttgggtgtgagatcagctcaatatctggatagggaagggaacccaggggctggagatcagaacatgagtggttcaaagtaaggctgtggagctgcagggacccagggaggagacctggcccagtcacgggacatgacaagggtcttccactccatcgacctcaacatgctcatgtgtacatgggaagaatgccccaaacactacacttcctgaggactgtgtgagacttggagtggaatacgtgcagcacatgacatggtcagcaagggacagttgctgctgttgtttcttatcacaataaaaataacaataattatgtatttattactattattgtaattatttgttagtagtatttttatcacaaaggaaaaaagatgtttaaaaaagaaaaaaatggcatagatatcaaggcaatgttacccaggtggtcattctgccacagggcagaaattgtctgacctgaaaattcaagagagatcagtgcaaataataatgaacccaaggtgtgtcccccgtccctaagagaaagggcccctagaattttggctgcaagagcctaggcattctctgggactaatctccctcaaaaatccataaccaggagatttaaaatatcttttttagtatcttcttaataaaataaaaagttcattgctttgccattcacattaagcttttgctttagcaaatccattgaaaggacttttttcttcaaggcatttacacgaaattgtgttgatgtgataacagagccctaaatattttaaatcaatcacagttgatgtggcagcttaatctacttagtgttgttccctggaaggtttatatgctgatgcttagatttctgaggctgggagcacaggagccctgaggattcttgcttccttttttaataatgggaaagtaaactttgatgatcgcttttgcctactctgtgacttaactgtttcaattccaaacacttcctttaaaaaagttagggggtggggggagattagaatgaaaatgccctaaagcatttgcagaggggctcatttgcttggagatgttagttctaagaagataagctgtgtacgtgggaaacagccactgcagtccatagcttgttggcagaaaaatgccttattgatttgttttgtttcccagaaaggatcttaaacatactaaacattgcaaaatattggagactgaggaagagaagaggtgggcagccatagaggcttctgggagtctccaacccttgacctaagctttaaacacacaaagtgggaaaagctccagtttactgaagcagtcgcccacatgccagaatgtgagctcaacactggctgtgaactcagcactggctgtgaactcatcactggctgtgaactcagtgtatctgtcttgctgattctctaaagagagtcctgtggctcatggtggccacaaactgattttgataagcaaaatgcatatcttcattttattcttctgggaaaatgtcataaaattacatcgaattttgattttaataaaaactaaagacagcttaatagagtcctacaactttttaaagtttattaaagtttgtttattcataaactaaacgtaagatgttactgaagatgaagattttgaggcctgtgagtgagtgttctgttaagaatgtgcactttgatgcagggctcagtaattttgcaaagttcctagtatgtaggcatatgggcaaagagttggaattctccaagttttgatgaaagttctttgttaccgccattacatggttgattgtgtttccagctgccactctttgtttataaattactctttgtttttcttttgtttgtttttttttttgagatggagtcttgctttgtcacccaggctggagtgtagtggcgcaatctcggctcactgcaagctccgcctcccagggtcacaccattctcctgcctcagcctcctgagtagctgggactaacaggcgcctgccaccatgcccggctaattttttttttttggtatttttagtagaggtggggtttcaccgtgttagccaggatggtctcagtcatcttcgttatcatcatatgcatgagctatagtgggacagcacagaatttttggccaataatttgctaataatgactttaagttattaaatatttcagctaaacaatgagtcatccatacttcttttaccaaagcagtcacatgcatatgcatatccaaaatacatataattattcagtgatatgccattatcatggaatgactcacagccctgtggaaagctggaacatgttagggtcattggaggacaacatctttccttatgtatataaaagatcttatcccctcaaagggcagtggaggtagagtgagggatgatgaactcgagaagatatttatagagctcagcctggagtcatcagcctgggatggcagggaaagtgagaaaagggcccgaagggtatttatttcatatctggtttggcatggatgaaattccagggctggattttccttaactagtcaagaacataaaagtacttgaaaaatgtgatcagatcaggagacccagtttggcacggaagcatttccccgtgcatgtcagcaggaatcatgttagatgagactctcgaagctgcccctggcactagttccccttgcgtggttctaggacccatgcagtcaggcagcccctgacaaggagtagctgctgggaagtctcctgccaacaatactcacttctgctccaccctgcccagtccaccgccctcgcctggactccatggcaccctccccattttctgcagccctgccctgactcctgaggcccccttctcccagtcacagcccttgccacagtccccacggagccaccgtcctggttccacctacctgggagcccccaagagagactgtcttcactgtcccacactaactgccaccttcactgggtggccagcatggaggaagtggggatgtggctagtctggccagaaaggacttccttccagaactgctgctgctggagaggggtttagtgcctcttgagttggaactcagaatgctctcattagcgatgtagtcaggcccactgtacaaggagcagagcctttcctaagctagggccctcagtcctgctggatgagcaccaaaccctggtggtgtgaccattaccctccatctgtgtgtcctgctcatgtctagggactgcaaggccagcgtgaggcaaggcctgctttgcacttctttatagtttctcaaagcatctttaaagagtcagcactcatgacctaatagttttctgttccaatgaagtgctctaagaggtaccagcaaaaggtcaggtgggccccaggcagataaatttgagttaatgaattttgggggtggggcaattccatgctttattgtcttgagtattcaaggaggtggagagtgtgtaggagtagtagtgcagtgtagtagatcacagtggattttcacactttcatggaagaaaacacattattaaaatgaaagccctcctggggatcgtggaatggttttcagggtctgttttccacagggggcacattcaccaaaagaaaagggaactctttgttcatccagattcccataaactctctaaatcccatgaaagcagaacaaacttaagtaacacttcacgtgaaacttgcatattggctttaatttacattcatgacacgttagatatgttgtacactttgtgtgccttgtgtcacgctgatacccagtgtgctgagtacctgcttcctgcgtgttgtgaacagaccagagccagttgtgaccatcgataactggtacagtcttcagtgaatagcggcagccttggacggttcgacgcagatgaagaaaatctagcacaccatctttttatctaagaaagcaatatgctggaaccattagacattaatgacacttatgctacttttctttagagacaggctctcactatgttgcccaggctggcctcaaacttgtgtgctcctggcttcgcctcctgagcagctgggactgcaggaacctgccactgagccccaaccttttatgctgtttttaaaactccctgacatacatttggagactgatatgtgaggtgcttacagaagccccctggagtgtagattcttgattgggttctgcaaatattaactgcctctgaagcacctggctagggcacttcaactgctagcaaactgctcccaggtagtagatcaaagtggatttttacacccgtcatacatcttagtgaccatactgatgttttttaaataagttatggagcaggcagtacaatgggaattggaatgatgttcaaatatgtacattactatgtaaaccatagatctgtagttatttggacctcttattgattacatctcttatttgcatgatgggaaatgtttggttagacaaggacatcactctcagtaaattggcagaaacttgtgattagcttgacaaagctcctttgtggaagagcagggcagagtctttgtagtgatgatgcctgtgtttaaacaaaagcttcaccacgtaaaagctgtatgaacttggatgaatatttgacctctttgtgtctctgctgccttgtctgcaaaacaaagataacagcagtatatgctccataaggtcacagaggaaattgaaataagctaatacacatagagctcttagaatagtgcctgccactggtaacgtctacgtattggtggtacaactactattgctttaccttgtaatttcccaaactcggtaaaataagaggcacctgctcaactatttcatttgcaatgtcaggaatcggaagcattaatgtgtaattaatgatacctatcagtgttgaaaactctgaagctctattcactcataaaatattatctgtagtatgttcacatagaaaatgcactatgagttcccagtcatcctagaaatgctattgataccatgttgaacacctcttcaagagccttctgtccacgtttagattctccaagctgaaatcacacccttagttgccactgatgcctgacagagagacagctgttttccttttatgagccccaaagttcttgtgacttggtaaaaattatgcctcatgatctcttacagaaattgagtacttaaaaaaattatattccacttcatctatgacttctaagggaggatatgaaagtaaaagtaatgatgaaaatatctaaaatgtaatcagtgtctggcgaagctatcagacctatgaggtactgtgcaatggagcattggctcaatcaaatagcaatcattctgagcaggagtctgaatgctttgggtatttcatgtaactaaaatgagtattttccttgtctagtcctagtctccaactctgtaaagtattaatgatcttgacttgaagaacatgttaattttaccttgtagagagacaaggaggaaaagccaagaagctgtttggtagaagttcagttggctctgaccagaaaatggctgagatggcctaagagttccattccttctgtgcttctctgaacctgtgagagatttctgggtttctagatttctgcaaggatcaacaggaaaacagtgttctaaggcaggaaataagaatgtcaggagcataacatagactgtgattgccacaggtaagccaggctggctgccaaggccctcttagccccctgggtccaactgcacctgttcctcacttgaccctgagtcccaccagaccctcccctgccatcgtctgctctcaacgtagcaatcatggcatcatggctgcctcagtgccaaactttaaatccaggtaggtcaccaggaaacaccagcacatcctaaccagcaccatctctctgtttctgcgatcatgggcagaccactatctttctgctgtaacaacacaaagtgtatgccctcacttgcctatgttcatctgagttttcttgaaagaaaaacacatggctattgattctctaatcacagaaggaggtagtgttggagctgaaatggacgttagcagacattgagtccagcagtcagtaaactgtttctgtaaatggctaatagagtctgggtaatagagtcagggttttgcaggacatatggtcttcattgccactgctcaagcctgttgtcatagcaaaacagcagccatacaccataagcatggctgtgttccaataaactttatttgtggacagcgaaatttgaatttcttgtaattctcacatgtcattaaatattcttcttttttaccagctattaaaaaacacaaaaccaattcttagctctcaggtcatacaaaagagacagcaagccagatttggcccaaaagccatagtaagccaatcccaatttgtccagtcatcacattcacagacgaggctactgacatcatgtctgaattcttccagctcttgtcgtctgtatcaagatcatttgtaatgacaaccaattatttcaaattttgcttctccaaataagtctagttacttgaagtcaagaactgtattttatattgtatgtttcccataacaccagtgactctctgagtacttaataaatgttcagaaaatacttttgaatgagttaattcacagagagaaactcacatattctaggaacctccacaaggaaatcatattgtttctccatgatcactcttattagaatttccatttccacaaaattccctcaacagaaaaacacctgattaacaaaaagcaacagtaattgttaacctcgttttaattatgagtttcacgttttatccccaaggataaaggaaaaaactggagtgacgttgggaaggacatggtcttcttaccgtgagcccaggggcacaggatcatagctcatcagactctagaccatctaaattcatgctaagtcatagttcacatactgaatgaatagagtaggaatagcagtatctaagtttcagtgagtctttcttccatgccaggccttacacaaataaacttcgagagcgctatgaagaaagctctaggattgttccttggtatcctcgggagactggttccaggaaccccactgcacccacccttcttcaatcagataccagagtctgaggatgctcaagttccttgtgtgaaatggcttagcatttgcctattacccgtgctcatcctccgggatactttaaatcatctctaaatcacttataaatacctaacaccatgcaaagcctatgtaaatagttgatatgctgtattttttatttgtaatattttttatggtcacactgttatttttttctttaatatttttgatctgcatttggtgggagggtctagagatgtggaatttttagacacagagggccaactctttccttatcctattgcacagctgtggaaactattaagtggcctttctgtggacaaacaaccagtagggagcctgcctgaagctgctaagcactttcctgctgcatatgagttgcattaatttcttgcctatgaaattaggcttgggtccatactcaagttctgggtgcagcatcctgtagatgtgtctgctcaatgccccaggcttgaaccatctgtgctgtaaaaggtgtgtctcatggcacagatttaagagcccaacagaccttgatttaagccctctgtgagccattcagctgcctggtgaccaaatcacaaaccttgtctgaccctcagtttcctggtctggatgataaaacttcaggcacctttctcaaagaattattgcaaagttaaacaagagcgcttctgtggaagcgcaggcatattacagtggaaccataagaaattgccaacaggttcattgtatattagcatgtgcatgtgagatgtccggtgaaggtcaactttcttctcccatcctgctggctatgctggatgagatctcagatatggtaaagtctcagatgtctgcgtgcccagcacagagaatttaccatggaaaaggcgggggtattttttgactggaaggtcagacctattcacctccaggtatagcatctccagggcccccccagcaaacaggagataaaagggatgactgctctcctggtctgtgggtttctcccaagagaaacttgacagagacttccttgctccaaatcttcctcttcgtggctccttgtttctggtactgattcccaccaccctcctaattgccatggtgaccagtcggtttgctatttaattaatgttgtatctgattacatctgtaccctgggagttctccagccaagagttgcaatttaaactcagaaataaataaaacgttcagctgtgaggatgggggaattatcctagtcaatcccggaatattcttccgacctttcttagatgaaaaattatctggtggaagttggagtgaggcagtagtacacaatgaagaaggaacaatattctgcttttggaatatttaaaaggaagcctcagacagcagctaggggtcctgcttagcggatagagctttggaaagaggaaatattagaaatttggttgagaattttctatgaagttcagtgctaagagcagagaccacaacttaggctttgcagccagcattcccttccataaacttcaaacgtaagcctgatcagaacaaggctagcaggaagatgtgctggtggggacaggctaggtcctgctgtgggtagcaaaaaacaaacaaaagcaaacagaacactgcctctaatttaaaacagcaaagtgtatttctcgtcggagatcactcaagcccactctagatcagggatggggaggaggtgaggctctttccctcacggtcactcaaggtcccaggctgctggggctgtcctcttaggcatcgcagccacactagtggaaaggggagtgttccggagggacacaagctggggaataaatgcttggcctgggaatgaccctggcacttctacgcatgactcattgtccagaacacctcatatggtcccaccagggttccaggaagtagcactgagccattgtccagaagagggggaggccagacatgtctgggaggcaggactgaagaccccacatctgggcagctttcttgccaacagtgggcctcaagtttggtgcccaaagcagaagaggaattgtctagagggatgttggggaatctctcagaatcaacaggaagatcagagttgggttgagaaagcaggcagccgtccagggcagctgaggggacgccaggggtccatctggttgggacactgctgtgggggaatgggagtatgggagaggcattgtctgcccggatcacaaatgacgttcttgaatgagctgcaaatagaaatgccatgtcccccatggaatcatcaatatggcaacttgggaagcgtattccaggaaaaagctagggtgtgtaacgttttattgttgcaaactctatcatttcacacttaaatgataatcgcaaggagagccatcagaaccattagtcatcatctcttcaatgcgaaggttcgtaattgtcacatgcaccttgcaataaggcaccttgcaataagctcccttccttcttggcatctccttggagcctgtgaagtgatgaatgcagttcccaatgcacagccctcaaactgcatgggagaaaccccagtgtcccagaggacagtgggggcggcttcagcgtggctgtgtggcactgaaacaggttaaccgcaaacctctagttctcagaaccaaagctgaatccacatttgaaaatccagtagaagctttgttaatattttaggaaggctattgagtattttaattcaacatgaagaggtgatctagctggtcttgtgaaaaatcagtaataaatctaaagggagaatgttctctaaaggtacaggaagaattctcattggtcttgagaaatgtccttacaattaatgacctactcctgagagatcgtgacaaatatcttaggatgttcagtgactatatttttctatctttcaaattatgcatttcattgtgagattaggacaaacacacttttacctttttttatagcgccctaatgaaacttatgtatttgaggttgagatatttgacacccttgggaactctaatttcttttttttttttttccgtcttcttaagtcacctaaggacattagaccatttgccctattattgagagttttactaaaatgcaagctgcaaatgccagaaggaagataggcaacaagacaatatgtacttaaaagagtttcatttgatactcagaagctggaactagacttagctcttttgctcactaaacctgtattctaacctttttgggcctcagtgtctttttcttgttctggaagcatcactagggtggaccagataatgctaaactcctttccgtctctaacccttttcatgtttaattatcagtgccataagcacacagcgttgatggtatgaagtctgtgtccatgccagataacttcacaaggaaatagttaacaattctcggttttacttagtaaacatacgggagcaatgctcctcagttgcaatggtgggggctgggcacgtgggtatctcggcctttttgtccccttcctctcccctttcgtcacccccacacacaggacatttgcgtactgggagaacctttattagatgattctgataaaccttctccttatccccacgtgaaacctatctgccctaaaggaatcagtcttctgtctcctttactccccatttttttctttctataaaatttgcattattggcataacttttctctttactatgggttatctttgggaaggtgtaagggaatgcaaagatagctcacctccacgtcagagctccctgcacttgcaggcgtggagaggacatacccttcgtcactcgttctgtgcgttaggaccagagtggaagaggatgcgaggagtcagatttcaggtcagttgctcttccccagccttcaagcaatggcagaggctgtcctgggaaggtcatgctcttctgtctgggttatctgaagtgatcattgcaccgagtgggagactggacatgcagacctatcatctgcagccatacaagctcatgattctgggcaccctgagtcaagtcccagagcccaggcaacctggcagaacccaggaagggtgaagcctctgcatgctggccactcaggcctacgattagcccctccccagcacatccgtgcattcagcgcaaggccaagctccatccagtcgatggaaatgggcacctgagcctcagaaacacccaaagaagagagcacctttcagctcttcatggaagaaagcgagccagccagcaccttcttctttttgcaggaataaatatgtctggcacctggattattttatttaaaaggccagctgtgtggacaccatgcctataaagtattgggatttttaatgaatgttaaccaaggaagagcccagctaggatacttcctgtaggtgtcactttgtggaggtcttaggtgctatccaaccctaaggacaaggcagccaggccagctgaaggatttcagatcagctctttctctgctcaccaccctcattattatccacttcttttatgggtccactcagatgctcatgctcacagtcttacctcccttctctccatccagaaaggtgaaacctcacccaccgccatgtggctcccacatcccagtgtcctgcatctgtgtctccagaaacatggcagagatagaagaaatttacatgtagcaaaattcatctcttcaagaagatattccaacacctgacagtggcccacacagtcctcatttactagggaatcctatttcgagccccttctgggcgcccagattggatgagtcactatggattgcagtgccccacccaacggggtacctgaaaaagaggaagaaagggaggcagggagggaaggagatgaaggaggtccaagacagggacccttcccttgaggaactgatacacagtcagtccgatggaggccaagaccacctgcaggaagcagctccttccttccattattcgagtgggattcatgcatttattctgcaccgaagccctctaccaggtcctccaagggagacagagatgctttaagatctggacctgccttcacaaagtgtatatcctgcaagatggtattgaaccacatcctaattacatggcacaaatctttcacacatttagacacttttggcagaatggtatcttctgatttaaaactgcagaaacatgaaaattagaaaaccaaacaaccattaatgcattaactcaagagttcattcctaaaatccaaatttccttctctggagataggaccagatcatagctcccaatcttttctccagtttttgttttacgacatttcggatttgagattctgtaagaagtgacctaatgtgagcatttcctgatatggaggagacgcaaaatagctcagggaaaaagttgatcattagaaaaatctgtggttgtcccactgtctcatcgtgccactgggagtttctggcctccgctggcatctctgatgaatgttctatgccaggacaaagaaggcgggcatgggccaggcagtccctccagtcagggaacggtggcctctcccagctgccttggtgtttaggaggccctgtaagggtatttgggatctcaagagcctctgggacttacgggcaaagggcagaccttaagagccagtccctcctcccccaaaatgtttagcaagccagaaattcccctttactgctaagtcaaaggaagatgttctttgactcttcagggagcataacgtaccatcctttgatggtcatacacattaaaagaagataaagccagaaataaaagggaaagaaacagttatatgattttggtgggaatttgcagaaatacaggctgaagctgaagtcttccatcaggtgaggttttttccattgatctcatctctcgggctcagctcttttatctccagcgcattttggatgtggcttctctttccacctgctgggcctttagatagagtacttccttttgtttcaaggtagcatttaactgagtctggaaaaaccatcattaagggaaaataaagctgaaagatgaattgaaaactatgtaaaagggccctttcaggctgccggagagattgcctttccagcctaatgagcctgtgctgcctctgattcagatggtgcaaggacaggagaaaagaatggagttttgtgcactgcgattttccaaagcacataatgcttagtcatttggggtgttaggaaagagagaaagtcggagcggagtgtgtggtgaagtgagagaaagaaagaaggctgaattttcgttaagctgctcaaatgcctgctttaacaaaagtctgccagggctagaggtgattagccatcagtgctgctgctgtttttgctgtcgtttttgctgttgctgaagtttaaaggtcctgtgccccttggtatatacgcaggggattggttccaggacccctgcattaccaaaattcaaacatactccagtcccagtcagccctgaggacccaggtatatgaaggggtatatacgcaggggattggttccaggacccctgagttaccaaaattcaaacatactccagtcccagtcagccctgaggacccaggtatatgaaaagtcagtcctccatatacagggatttcacatccctcaaatactgtactttccatatgtatttggttgaaaaaatctgcacataagtcgacccacgcagttcaaacctatattgttcaagggtctgctgtcccgtccttatgtgggatggtgacaagcggccctgtgtcccatggcgtgcagctgagcggccttggtgcagaggtggatttgcagccagttgtccacacatcctggatcctcccggtgcgtcctgtgtaatgggttaactggacctgcctaagcctgggcctcccacccctcaaaagcagcttctccaagctttcctacttaaatttctccagccacagagagaagcatttattgtctctcaccacacccgccccccagtatagaagaaaggaagactggggaattgatctctcagagcacttggagaagccacacgtcagcagccagtaaagctagaatgaaaatctgagcgatcaaggcaatggaatagaaagtcaaaacccaaacttcatctcttccccactaaaggaacgggaagggacactgccacctggcggccagccgaggcatgttcggggagccgatcctcctccctgggccccccacggtgttgatttgtgggaatttgcagatctctgatgataatgaggggattcgcagtgtgtgatatgcaaataacacagctctgattagtgaaggaggctgcgagccttgcaaggtaaaagctccatttgccttctggcttgatgttcgctgatttcttttttaaccccccatttaattctgctctcggcaccttggataaaatatttagtggcaggaaaaaggcaacagatgcaagcaggaataaataagattttctgtatttagaatgaggccacgtatttcggagcacagatctatcaggcatgttatttatgtcttttgcaatttcccgggacccagatttctcagggtgctttgatttttctcaaatatctacagcagtaggggtccagggagcccagggagcacagccaggcactcactcacagtcagaatccagggggctgtgttatttaggatgatccgaaacgcgaccttgctgcctgcattctgttttgatatgtatcttgcctcattaaaagatgacaatctgcaatactgatattactcaggcagatggatttcccaaatgctgggctatagcctgggctgccagactgcatgaggtttaacatggaaaattaactgcagtcttgttctctggtctgccaggtccagcagtgtagtggaaggagcaaaggagcaggaatcaggagactcaccaggatctgccctctcctgtcctgtgatcctgagaaaatggcttggtctcctcatcctggaggtctccatagtggagtgggctcaacatcacacctggagtcaagtcaaggctccgcacgtcccagtgacctagagccagttgtcaacatctctgagcctcaaaattctcctttataacaaataatgtaagcagatccacagtcactaggaagattacaatagaattgccagagtatctagcattcagtaaatatttattaactagatagaaaaaaaatgtaccaggcttagtaacacccggccttcccatctcattagaggctagaatgctcaatggacacagggtgtgtcttagtctgttttgtgttgccataaaggaatacctgaaactgggcaatttataaaaagaagagtttatttgcctcagggttctatagcctgtgcaagacacatgcaccagcacctgcttagcttctggtgaggcctcaggctgcttctactcatggcagaagatgaagtggagctggttgtacagagatcacatagtgagagagaaagcaacagggtgtttaggaggtgccaggctcttttataacagcccgccctcacaggagtgaaatcaagcgagaactcactcacccttgggggaggccattaaccttttcatgaaaaatccacccccatgacccacacacctcccactagaccccacctcccatgacccacacacctcccactagaccccacctccaacattggggatcaaatttcaacacgaagtttggaggggacaggaagccaggccatagcagggcatatagcattggcatcaaagctagggtgttgattggttatgaatattgttggtcctgcctcatttatcaaggaaagaagaaaaaagaagactgtagaaagactaagttcagggtatacatgagtcttcaagagaagccagacaacattccaggatttcagaaaggggacatggctgagctgggtcttctctttgtggggagacatgtcattgggcctctgagttccaaagacacaacctggaaaaagcacaaaaagactgtctacttagaagatttaggatttcccgcatagtccccagggcctcctctgatcctttgaccaagatatgaaagccctgccatataagaagaggggagctccatgctgaggttaggacacagcactgatatgatgccggccttccttggtctatttgacacctaatgaggtggggacttgttgacaaagtccttccatcgtgaggtctgcacccctcacccccagcttgattgtaccattctgttttggaaatccccaccagaagtaccagcaaatgcttcttaagcttctagaaatttctatctgggattattttgttcatagagcaattctggcagccagagttacttctgcatctttgctttggaccacaatcacccaaaaagcattaggagaaaagagatcacagcaatggttcactcaattttcaacttccctatgctgtttagattttggcaaaagagtattcactgtgactgctgcttttcactataaaaagaagctgagatttcctgccaactatttcacaaaaacaaacagaagattcattgagagaaccaaggaagcatctgatcctacaacacacgaccaaaatatactgtctgtatcttggaaatgaactccctaagaggatagaaaataagtcgttcaagctcttctctaactcaagtataagcaccctataactggaattatgtcttttacctcctgcttattcccagggctgaggggaccattcgtagctgataatatcagttacaatcatgcaggatcatccaggaataaaaacattggaggaaggcagcatgaaagggaaagaaaatcctggttttcagaaaataacatggagacctcatgagctcactctgagtaatcacccttcagcagtagcatctccctatccagtctgctccgtttaagggaagagttcatctcaccacagtgtttcattgaagagctggtttttaattggccctgtaccacttaatttattttcatttgcattccaatgctgtctgccttgtactgctttacttcaaagctggatctaaaaaacataggctcttagaaggttgcaaacctgcaattgtacagaggctctgagaagcgaaatgatttgcccagtgaaatggggtagtgtggaaactgagagagctctgaagtctaacacccctggcttcacaattctacctccaccatttactggttgtatgaactcaagcaaattgattcacctgtcagacctcagtttcctcctctgtaagatggaactagcagcatcgaccttgtggggtcattgtgcgaatcgccatactgtgttagtctagcattgctagtcacttactaggcactcgcgaagtgtagctgactcctagtgttgttgctcttagaaaacacccatatgttagaaaaaaaaaatagaacactttttctgcctctgaataagtgcctaagatcctctaccacttcttgctatgaccacccacccagagtaaggaagacagctgctcccccagcctcagcaatgcggagacggtgtccaattctccactgacaccctagttttttctgtacggtgcatgggaaaatgtataataaaaagcaaagtgcgtcacaaatgataggtagtcctcacgttattagtagtaatagttgctatattgagtgctgtgggtccaggcagattggtttatagtcactgagatatgttgatctaataataatgagaatgaatagataaaggggtacaagctgtcagctgacaataatgtctgaataacatcagtttggtttgcttacgtaatgggtcttacatgaagaggagacactcggaactcaacacctgaactcctcccgcttccggcaaggagagaggcagaaggcgcccacgtggtggacagcagcccatgtagaggggccacagaaaagggtgatgggcatcctctctgcacagggcagagctgcagggtgttgggagtcggcttgctcctctccacctcctcccttctgccatgttcccacctgtctcagtcagtctgcagtaacagctatagaatgtcttcatttggaacttggagaatttgcacaaagggaagcagactggacaaagagctcagatcgggggtctccgggtctgggcacagccgttacccttcccctcccatcctccgttctctcctgccgccacccacactgtgctcctggtgagctagagccagagcgaagtggaacccagagcactgtttgccaacacccgcggcactagacaacgccaagagaatggcttagtaataatgagataataacttaatgaaaaacccctgcgagccctgcggggcggggagggagacctggtgtgtggtgctggacgcttcctgagcacctccctgcacagcctgcctctggagtttctcgcgcatggcggtaagcagggccaggcctcactctttccccttcacagtggagggtgtgagcagggcttcgatgccttttgctcacggtgtccagcagtggatgcgctggttggaacggacgtgcctataaccatgactcccaccgaggccttgtcctgcaagcccagttcccatcaacagctcattctagggagggtggaggcccagtaccgcaggcttgctgcatttgggtatttccaggtggctcaagtcaaacttaagagcgcgacccattcggaaaatcaagtgaataaagcaggatggcatggaaagggatgggggctttactgagagagggtgagggaggataggacgggacaggagagagagggatggaggctttactgagagagggtgagggagcataggatgggaaagagagggatggaggctttactgagagagggtgagagagcataggaccggaaagagaaggatggcggctttactgagagagggtgagggagcataggacaggagggagagggatggcggctttactgagagagggtgagggagcataggacaggagggagagggatggaggctttactgagagagggtgagggagcataggacaggagggagagggatggcggctttactgagagagtgtgagggagcataggatgggagagagagggatggaggctttactgagagagggtgagagcataggacgagagagagagggatggaggctttactgagagagggtgagggagcataggacaggagggagagggatggcggctttactgagagagggtgagagagcataggacgggagagagagggatggaggctttactgagagagggtgagagagcataggacgggagagagagggatggaggctttactgagagatggtcagggagcataggacgggagagagagggatggaggctttactgtgagagtgtgaggaagcataggacgggaaagagagggatggggcattactgagagaggatgagagagcataggatgggaaagagagggatggaggctttactgagcgagggtgagagagcataggacgggaaagagagggatggaggctttactgagagagggtgagagagcataggacgggaaagagagggatggaggctttactgtgagagtgtgaggaagcataggacgggaaagagagggatggggcattactgagagagggtgagagagcataggatgggaaagagagggatggaggctttactgagcgagggtgagagagcataggacgggaaagagagggatggaggctttactgagagagggtgagagagcataggacgggaaagagagggatggaggctttactgtgagagtgtgaggaagcataggacggaaaataccagagtgcaatagagaaggtgcaaaggagagctgcttcccacacccttgctcctggcctgtgtgtgtccgtgatgctgggtcatggtcaaaaacacggatggccgctgacatgggtctttacagagaaaggctccatccaatctgaaaggcctgcagcaggcagaacctatccgtagatgaacaccctcgctctccagaagacaagaagcgggagtcgcagcctattgaagtgtagacatgatgtctacacagccaccctgtgtcctgcaagagcccaggctcagagcgtgtgcaccgtgagggccgcctgtgccggagcaggccgcttctccgtagcaaccacatcccacagtgtggaggttcccagcggcgggtagtgcggaaaacagggaaggcaggaaagaaacttagccaggcactgagtgcgtgggaaggcaaaacactcttttctcctcccacggcgggggcgctccctgggcgatgctcacggagagtgggagggcgtcccgcaccgggcagagctgaagggtggcgggggtcggcttcctcctctctgcctcttcccttccgccacgcttcctacccacaccagccagtctccagtaacagatatagaatgccttcatttggaacacggagagacaagcgtgccgtgtgggaaggagagaagccgctgctggagcaagcgtggtcccagaggagagcctgatttgagttaaagcgagagggcaggagaagcagttgggaatcgaggcagtgggccgaggatggcccaggttcaagaggcacagtgggaggctgcaggtgtaaggagaaggacggctcaggtgagggctgcacaggcgctgaggggatggggctctgggtggtgacatctccaaggcaagagagcacgtagatttcagagcaaaactatctgggtcagaatcccggatccaccctttatcactataaaatgttgggcaagtactcacagtgcctctgctctctcatgtataaaatgtgaggaaccatagcaccaaaatcatggaggtgttaggcagatggatgtgctgggaggaaacctgtttactagggggctgggttggagatggggagcttcttatgatgtctgctgtcagcagctttaaaggagatgtgggtgtctatcctggtggtctccctatcagcctgggatcaggtggtgagtggcttcacctactaagcccaaagatgtgttaggaaaacaggccgatatctatcgataaggaaaactggccggcacgatggctcatgcctgtaatcccagcactttgggagaccaaggcgggccgatcacctgaggtcaggagttcgagaccagcctggccaacatggcaaaaccctgtctctcctaaaaatacaaaaaaaaaaaaaaattagtcgggcgtggtggtgggtgtctgttgtccccactactctagaggctgaggtggaagaatcgcttgaacccaggaggtggaggttgcaatgagctgagatcgtgccactgcactccagcctgggtgacagagtgagactctgtctcaaaaaaaaaaaaaaaaaagaaaatgaaactcaaagggtcatgtcatctccgtcatctcctaagtgctgcaccactaaccaggcagataggacagacacatgtccagaacatcgacgcgggcccatgtgcttccctagagcagcgcccccgaggcagggacggataggacttccacagcatcatcgtcctctgagagggaagaagcaacgtgggagggctgcatggccggtggggggtccctctgggatgtgcatgatgctgggggaggggaaggaggagctggagacagggcaagtcctggtagcagtgtcaccctaaaaagggatcctgatccagatgccaagagagggttcttgggtcttgtgcaggaaggagttcaaggtgagtctcagagtacaatgagaagacagagtttattgaaagttgctcagttacagagcagggcgtccttggaaagcaaagggaggaatgcgccatctttgtttttctcatataggggccttgtctatgtaaagactgaactaagctgtgtctgcttgggtgggggagccgacagcatgacaaaatgtatattattctattgttttaaagaaaaggatccttaacatttcagtgtgtaagtacatcaaagcataactataattatctccaaagtgataatgttaccagtactggacatcaaggctttctgttgttggaggagtttttgtccttgcaggcatcaccaagttgcttccttagctgtaaacatcttaggaccatgggctgtgactggcaaggagcgggccttgctagtttcaagatagagttggttttaaaaagatgttgccctggctctcctgggctcttgcttccctgacagcaggagtctcttctgcattttgtatactgcagctatctagaatctgcacactggaagaacgtaagtgtacaggaaccaggaagcttggagaggctgctggcctcctggtcttcctgtaggtactaaggaggcctcacccttctgggatccagggtctctccctcaaggcttgggttagggacattaacatctaaggaacactatccaccgcaggaggctgtagctctgacgtgcccaagaggaaagccctgacctacagtggcggccgctctgttctaggatgtggatggcacagactggtcagagagagccagaaggttctgggggtgagctgcagctgttggcccaggggtaaatgttgggttctacccagtgccatgttaagaccaagggaaagacatggtggacgggtgtggctctagtgaacgggatttccaccttagattctgttccccttgagccatttattgagcacctgctgtgtgccatgccctgtgcggggctgtttgtcctcctgctggggttgtgtttcttgggggacatagctctggccgcagagggattaatcatgcctgaaggacctgggaggcctccaggaagtgtggccactggacacagtctaattcccttctcttccgagaccttcacgcttgcctcctgcggtcctgcccaggctacaaagttgacattgtctcctaaacagtttctttggtgctaaattgtcaggttgcaaaagctatgagggaataaacgggtggtgcatggagctggtgtcactcattgatcaacgtgctattatacgctggggtacaaagggtgcccggtgacccttccgaatctattatttactcgaaagcagtgaccacatccacacacccagggtgacacagggtgtgtgacgaggcccacagatacatgccgatttgcaggggcacctgcactgggtctggggagccatcatcctccacaggagacagcgaccacctgtggatttttgaaagaaaggagtggcatggatttccccgagcgccacctctcattcctcctctcccattcatggtcacagcctgtgtttgagagaaggctgtccagctggggccatctgggtgtggggcaggatgaagctcacgtgccagtgtggaatcgacaccctcattctctttagtatcatgcagtccccacagcgacttctgcttcaggctagttccgtaacccgggaaattttgaggatggaaaagggcagggacaggagcggtcaggagtggctcagccctgagcccagggttttgcccagccgccttccgtctaggctgtccctccatccgcatccaagaagcggcatgcggacatctgtgactgtggaggatgcccatgcccctgtggggacaggaatccctctcctctacacagaggccctgagctgcttcctggggtcaggacacacctgcacaagttgaaaggccggctcttgttctttgaacaatagaaccaggaataattaatcatcggatatagttgggcagagaaactgcttataatttacaattaattaaccttccccttaaaaaaaaaactggagacctaatttcctgtctgatccacattgtttttgatatccattatttttcaatgtgtttttgttgagattaggaaatatttgtgcagaatatctcagtccgattaaggtgacaattgctcaggattttcgttgaaactgtgtattataatgaggctttctgcagcgcatcataaaaggaaaaattctttccatcatttaatttaaaactaaagccagactatgtaaaaaatattacatgtaattttaaggctataactttgttttgtggcgaaaaaattctaactttcagatgaggacaaaataaggtcagcattttttaaaacccttggaaaatccaaactctggtaaatctcagctggtagttaagtcactgtctaattaggattctaatttcacaatctcaattatttttaactttctggtgaatattaacagaatgatcagttttggcaaaatactaggaagaaaaatgtaaactaaggaaattaaaaatgatgatagggttcacaatccatattacctaaaacactcaaccagtcactgtatagatgagtaataacaaagtcagtctcagtataattgtgaacattccttttgaaattgaacatgtgaagacacatgcacacgtatgtttattgcagcactatttacaatagcaaagactcggaaccaacccaaatgctcatcaatgatagactggatacaggaaatgtggcacatatacaccatggaatactatgcagccataaaaaagaatgagttcatgtcctttgcagggacatggatgaagctggaaaccatcatcctcagcaaacaaacacaggaacagaaaaccaaacactgcatattctcactcgtaagtgggagttgaacaatgagaacacatggacccagggaggggaacatcatacactagggcctgtctgtgggtgggcggaaagaagagggagagcattaggacaaatacctaatgcatgcagggcttaaaacctagatgacgggttgatagatgcagcaaaccaccacggcacatgtatacctatgtaacaaacctgcacgttctgcacatgtatcccagaacttaaagtaaaataaattaaaaaaaaaaaaaaaagaaactgaacacatgtcaggagctgaatttaaaacaatgttttggtcagtaccaggacacgaatgacaggctgcctgcctgtccgaccctgggccttatagacagtgtcacttgataggatgttttgagacccggacatccccagcagcccagcatgcacaggctcagagcccacaggtgcacactggggttgtcatgggagacaggtgaggagactggagacaggcaggtgcagaaatgtctctgtcagtatttcccatgggttatctctcacttactagctgtgtgagcttcggcacattatttaaactttttttcccttagttcccttaagggaaaaaataaagataataatagtgtctacctggagtgattgcgttgaggattaaatgagttaacccatctacgcagttagagccggcttggcgtgtgctgggtgctcaccgactgctgggtgtggccatcaccatcaccacccttctaagaggacttacccggaagctgccaagtcttactggaattcaataagaaaacttacttccaaaaataaaaataaaagccacacacacattttccctgtaaatcttgataggaagaaggaaaaggtcaggatgttgccgagcccttgggttggaagaggtcggagtggggcgcgtcccaggtcgggaatgttaggacaaggtggcctctgtcttcatcgtgtgtcttgggtcccccttcgtaatgatactgtcctcaccacgtctttttattatgaaaaggaagagtggcgaggacttgagtgggactgttgggttgttgtgttgcagaggaaatatgctttttgcagagggcttagaaaacgtgcagtgaaaaaaacaatgagccttcttggccccaaggcctgtggctgctggcaggacagcggtcatctgctccaaccccctagggaagagtgagccgtttgctctttttctcttctccaacttcccagaacaatgagggtgatgaatgaagaggtttcccatgatagtgaggtaactctgtcagtagaagccctgagatgtccagaggcctgggctcaccaggccccaggtcagaaggctcggcagcgccccacacttggctttcggatcatctcgtgctgggctcatcttcccttgcggcttcctctgctccctcagttgggcccctgcctatacgtctccaggcccccgaggctggcatgcagccccatggtcataatcaatgttttatgacacctgcagactacaggcaatagtagacgattttacggataatagttaatagagctctcacatcgacaacccaatgagggcagcctgcttctatccctgtttacagaggaggaaactgaggcacccaggggctgggtcacttgcccatggtcacagctggtagggggcagggccggatttcagcctcgaaagtctagctcctgaggccatgctgctgcctgccacccatcccacctccttaaggtgctgtgttcccaccacttcctaatcctcaatctcctctcccctccccatccaggaagcctgctaggatggtccttgtccatattctccttcctggcctccacctgatgatagcttgttgtgatacttgattcagctcgcgagatattcctagaacaacgagagaaaaatgaaggcgcattaggcccgccacaatcaaagctgtcgttcccttctccatccctcacggcccccgaggaacaggccagcccctttccacccgtcacatcccctgaagaacaggccagccccttctccatcctttatatctgctgaggaacaagccagccccttctccatccctcacggcccctgaggaacaggccagccccttcttcatctttcacggcccctgaggaacaggccagcctctttccatccctcacggcccctgaagaactggccagccctttctccatccctcaggtctcctgaggaacaggccagccccttctccatccctcacgtaccctgaggaacttgccagccccttctccatccctcacgttccctgaggaactgggcagccccttctccatccctcacatcccctgaggaactgggcagccccttctccatccctcacatcctctgaggaactggccagcctcttctcctttccaatgggtgtgcaggtccctccctgcgaggccctgcaagtgtctgcaaatgcaccagctgatgcccactgcccagtgggtgttcagtgcactgaaaagttccctctcctcccccactgcagccctcctgcctcacttggagacaatgcagaaccaagatgggatcaatagtcattgatttctcttggtcttgaatgatttttacacaagtcattttgcaataagagggccttcgtacggtgcctgtctgcactgagggcgtgggatgacagccatttttgctcagatttctgcttcctgatccacggtaagatgtttcctccctagctggggagatcctcatggctgaagacagtgtcctggcctcttatctatcctctggagagtctgcctcacagcactggcatagtcgtggtgagcgcaggcactaggatggaaaatctccggcacacgggaggggcacgttcaacaagagttcaggataatccctgttaccacaggggtgttcaggccttcacaggttggcagagggcccaagtgtcatctgctggtcacctcagctctgtgaggaagaaggggtgcagaccaggaagtggctcagggaggtcggaggccagcccaaggagggggtgcctgagtggccccaaccaagtgccgcgctctcccccccgccctctccccgccgccctctcccgccacgcacggcctcctggcagctctgccttttgggcacacgcaccttccgtcttcactgaatccactcccccttcaggtgggcaaacactgcctcttgcagacatgttcttgcctgtgccctgtcctgggaactgtagttggcagttactttgaagagcttaggaaacagcatggagttctgtcaggtggcagacattctagaatctctctaacaaggctgagtcggtgtgtcagtcagggccgggaaacaggccgtggagctgcctcagaaggcccgcaagttcatggccacacctggttctgtgtaggaccacatgccttgtatgtcccattacattgaaatcttttcagactgtgatgaaggaaatacagattttttttttttttttgagacagagtctcgctctgttgcccaggctggagtgcagtggctcaatctcgactcactgaaatcttcacctcccaggttcaagcgattctcctgcctcagcctcctgagtagctgggattacaggcatgcaccgccacgtccagctaatttttgtatttttagtagagacggggtttcaccatgttgaccaggctggtctcaaactcctgaccttaagtgatctgctctcctcagcctcccaaagtgctgagattacaggtgtgagccactgcacctggccaaaatacagattattttaaaaaagacattgaatgtttagaactgaattaaactgataactgcaggtttttgtttgtttgtttgtttgttttgttttgtttgtaagaagggatgcttatattcacagagtttgaaaaacaagtgacctaagccaacccctcattttacagtagaagaaaggcagcccagagaggtgggaccagagctggagcctgggtcccaccgcctgtttgcgtccttcccgtgagagcacgcagcctctataagcagcaggtgggacccaggcgtttgtctatggattttcctctcaaagttgctcttctctttactagggcagatcccaattttgaggggcctagagtctatgaaatttgggggatcctctttagaaaaaggacagaagattgtgaatggaagcaaaggcccatgaaggggagaagctctgagacccagcttctccagccccctggtgcgaattcacccctcgccaccaccccgcagggatgctcccattccacagcaatttcccgcagactctccagaagtgtgcactccggctcactgcttccccagtcttcacatgtttgcttgtcacttgattatcctccccgaagaggagccacttgtactttaaatgcctccttcacatcagcaggcaattaacagtagggaagggagaaggagggtgagcagtgaggcttctcaatcacacaactcaagagcacggggacgttctcccaggagcagcctgtctcttgtgcctaaagcacaaggggcagcggcaataggacggaaggggaccacccacgggctggactctcgaggccaggcagaggccactgtgcggtctttccttccgcttccctctccctgagccttatgcaaatccggctcttagcacagcctttagctcttgtctgaattccaggggaggcccaagatgggaccccctacttcaaaaataagcttgaattcaaacctccagcattgttccacagtgcgcaggccagaagacatccattctgttcctccaattccctgtaaggcccctctctgtgtccagccagatagcgtgtctccaatccatggggttgcagaaggggctcgctgcctgtgcactagatgccaatacggtgacaccaggattttcagaaaagaaaagctttatattaaaagtctattcccagctgggcgtggtggctcatggccttgggaggccaaggagggcggatcacgaggtcaggagttcaagaccatccaggccaatatggtgaaaccccatctctactaaaaatataaaaaattagctgggcatggtggtgcacacctgtagtcccagctactcgggaggccgaggcagaagaatcacttgaacccagcaggcagaggttgcagtgagcagaaatcatgccattgcactccagcctaggtgacagagcgagattctgtctcaaaacaaaaaaaagtctattcccaaggagacaggcatccagctcaactctgcctccctgtgctggcttcaaggcagtaattttatttttaaaggaaaaggattcagcaggcggattctgggattagcaggtgattggtggaaggaacggggaggtttggaaagtccttcagcacacacaattatttcttcacgattactcatgggctgtgtgtgcaaattcaggggggtggggtggaggaaattcagtccatgacatcagcaagctcattctgcacagaccccagttgaccaacttggttctgacagacttcagccagttctcttatctcggggcggagggagcgtcagtgtttcagcaggttgtttctattcttgtctgccattctgcgagctcaagaacttctgttagccattcgtttctttaactctttgaggcattgtttcattattaggatgcttgcttatttcttgtctcttgagcaactgagtgggtggatgacccagtcgattaacaaatgagtgagaaacgagaacatccttgccacactgggacctgtttgagcgtgaggcaggtgagcagaagacatcaggcccagaagttctggaagctccctcaggtgcccacaacacaaatgaagaggaaagagagaagacaaaacaaaaagaagggtaaaggagcctggcatactggctcagccttcctctttcaaaacttttgtttttttttttttgagacagtcttgctgtgtcgcccaggcttgagtgcaatggtgcaatctcgactcactgcaacctccgcttccctggttcaagcgattctcctgcctcagcctcccggatagctgggactacaggcgcctgccaccatgcccggctaatttttgtatttttagtagagacagggtttcaccatgttgaccaggctggtctcaaactcttgaccttaagtgatccacccaccttggcctcccgaagtgctgagattataggtgtgagccaccgcacccagctcaaaacttttttgaaactaaatttgagctcagcgatctaaaatacaatggcataaaactgcaagtctataaactgggcatagctctttcctcctctgctctgcaccaactggggtgaccagaagggactgaacagtctaggggcaggtcttgctcactcacgcgtccatggctgacgctggctgctagatgaggcctgctctgtgtcagccaggacaccaaatgtggcctctccatctgaccagggcttgctcaccacatagaaggtggtgttcagagtgagtgacccaagcaagagagagccaggggaaagccataccaccctgtgtgaggccgttcttgcattgcgataaagaaatccccgagactgggtaatttagaaagaaaagaggtttaattggctcccagttctgcagactgtgcaggaagcatagaggcatctgcttctggagaggcctcaggaagcttccagtcacggcagaaggccaatggggagcaggtgcatcacgtggtgggagcaggagtgagagggagtgagtaggggtgagggaggcaccacacttttttttttcaaggttttattttatttttattttttattatactttaagttctagggtttgttacataggtatacatgtgccatgttggtgtgctgcacccattaactcgtcatttacattaggtatatctcctaatgctgtcatccccttcccccaccccatgacaggccctggtgtgtgatgttccccaccctgtgtccaagtgtcctcattgttcaattcccacctatgagtgagaacatgcagtgtttggttttctgtccttgcgatagtttgctcagaatgatggtttccagcttcatccatgtcccaaacagtcagatctcatgagaagccgctcactatcatgaggacagcacggagtagatggtgctaaaccatttgtgagaaatccaaccccatgattcagtggctcccacctggccccgactctagtatcagaatgacaattcaacatgagattcagacagggacacacatctgaactataacacaccctttatgacctagtctcacaagccatcactttctgccacattctcttcattcaaaacactgccctggttcaaggagcaaagaatcacctcttctttggggagtctcacgccctggaagtagcactgaggctagttttggaaaatacagtgtgccacactcaccaaggcgtcagtctctgtgaagtaaattatactgagacatcagtgacttcatagagaaagggcatgaataacccctaaccacaaataatggcaagaagtatccatggaggcatcttgggaagaggcttctgatgttccatgcctactccaggcagctgtgtgccccacggccttccgcagtagttgaattcgcagactgagcatggcattggacccgatggccttgcttccactgagcctctgcacaacactggccttgggaaagaccacaaaatagtaaccggcagggctcagtagacccggaagcttagaacctgtagaaaagagaaggcttcctgtgatcctcctgcttcaagcaagggctccgccatctctcctgcagataaaaactcaggaacattttatgttctgcttttggagggagtttataactttacattctgtcttaaagaaaacacaagttttgaattctgggataccgagttcctaaaagaaaatccaggcaacaggaggctcccaatgtgtccaacctgcctccgatggtgcaatgaaacagcaagtactaagaaaatcaccaaagtgtggaagtggcaggggactgctttaacagcaagagaaggagaaatcttagtcgtgctagttccacatcgtggctgcctttgacttctggccatttagaaatggctctgctgccagctgggtgcggtggctcacgcctgtaatcccagcactttgggaggcccaggcgggtggatcacccgaggtcaggagtttgagaccagcctggccaacatggtgaaaccccgtctctactaaaaatacagaaattagctgggtgtggtggcgggtgcctgtaatcctagctactcagaaggctgaggcaggagaatcacttgaacctgggaggcagaggttgcagtgagccgagattgtgccactgcactccagcctggatgatagatcgagactccatctcaaaaaaaggaaggaaggaaggaaggagagagagagagagagagagaaagaaagaaagggaaagggagaaaagaaaggaaagaaagaaaagaaaaatggcttgctgccgagggaagagagagagatgaaataaatatgtctcctcaccctcttcctacccctgagctaggcacagttcgcttgtccatatgatgagatatagatgcgagggtttagctgtggattccacagcctccatcagcagcctgcgtgctcctaataaaaatgcatcctagcctcccaccttggcctttcctcacccagaaaaacaaggccagtgaggtcctaaagagcctattctgcaggagcgcatgtgagaagaactcttagagaaacagcagcaagttcaatttccccagagaaccctaaagcctcctatttcccttcagcctcacgtctgtgctccctaagctggctttggatttctctttagctggacttcattggcaggtgcggcaggagggtgtggggagccccctagatacaactgccaaggagactttaagtctgcctcactcccggcctccctttttgtactttctagaactcctcttggtgccctctctacccacacccctgtgccctttctgctgtgcactcaccttgcacagacctgtggatttggatgccccacctccatctgcaccacacctgagctctgtgggcgctcttcacctctatgccctgggcactgcatcttaggccttggatgtcatttggaagcagagtctctcttccttgttaaagcattgctgggatacagaggggagagctgtcctttcccgggcttgggtcctttgtagaagctaaaatggcacctgttgggcagctctgtcttcatcttgtgaatggaattgaccactctcgctcggtggatttgctagaggagcttcatctgatgttatactaaggacctcaagaattcaccttattcttgacctgttaggtccatgaaagtgttactgtaacctgcgtggccaatgagatctccactccagccagcaagaagtgggaaagagaggcggtggtcataccctttctccttaaaggcggaagacaggtgtcactcatcaccttttctcaacccagcagcaggaactcagcacacacccaacctcacatctggggagtctgggaaaggtctttatcctgggaggccgtgtgcccacctacaagccattggttcttttactaaaaagagaagggagtgtgggtgttggaggacaatgagcaggttctgccattccaccttccacaagaggcttctctaatttcctccaataagaaagaggcctctctgtattcccagaccccatagttctttctggtttctaccttgcccactttccccgagttgcaagttgcagttctccttctgtttactgtattacaaacttccaagctttgtctctactttactataccctagggaattgtgtgtactgagtactcagtctttgttcaataaggttaatttccctgaacctccaattcctcagttgtaaaggggcacttaatataagcttgtaggtgcatcacattctctccagagagagaactcactcctaagaaagcagcaccaaaccattcatgagagatccacccccataacccagacacctcccactagtccccacctcccaacacctccacattgggaattagatttcaacatgagctttagtggggacaaacaaaccacttccaaaccacagcacacatatgaatgagatcattcggcattcgtctttctgtttctggtttatttcacttagcacaagtcctccaggtttatctactatgttgcaaatgccaggatttcctctcttctagctagtcattgttaaccagaatgtgcaccaaactcacctgaagaggttttgcagaaaaggagcctgtatcctcctcactgcccccaccaaataccagttctcctgcctgaagtgcagcctcagcatctgtataagcagcacacacatgcgcacaacagtccaatggagtcccctgcaaacctacctaaacctcactaggcaaataggaaataatagtggtggtcacctcttcatctgtcaaacaacctggaaaatgtgaagattcctcttcattgttgcattggcctttattaccttgagcacaaagggatttttctcctactggatatgaccttaatgctgcttggcaggaatgaataacactccagataatggcactggcttcttcaaggtatagtgacaaaaaatgaaaaatacccagcccagatcctacctggggctgaagctctggatacaacttttgccatcttcaagagagaagcagccattgaacaccgactgtccccggatgtatctttcttttctgatgctaaaatagccccccagcaggacagggaaggtgaagaaaagatgtattctctagttttcccaagttaattatacttgctcagaaagccaagtgattcattttgttccaaggcaggcgtccatgcaattaatttcgttgatgaaataggttttcttctgcaaaactctgcttctaaactgcatttggtgcatggcatttaagccaactgcctcattaagctggaatcctgcagaaaaatgtttgcagaatagggacatttggaattaatgctaaaatgtcaaggtttcttctgcccagcacttttttaccccttagtttcttatacttcattatcacattaatgagcaactaacgtacaggaaaataaaaatggcaaggagcgatgtgttcaaggacacctagggaaaataaactaaagctgccctagttttgtacggctggcattttggcgtggcacaggttcttcgcatgtgccactgtctcgatgtggaatgacattcagaggaactaccctctgccatcacacacaccagatacctgtcatccctgaacccgatgacccaatggtcgctaagttcccttcttttattttattttatttttttgagacctagtctcactctgtcacccaggctggagtacggtggcaagatctcggctcaccgcaacctcccaggttcaagtaatgattctcctgcctcagcctcccgagtagctgggattacaggtgtgcgcccagctaatttttgtatttttagtacagacagggtttcaccgtgttgaccagaatggtctcgaactcctgacctcaagtgatccacccacctcagcctcccaaagtgctgagattaaaggcgtgtctctaagtttccttctaaccgttacatttggtaacctgtagtgatggttttgttctacctcccagttctctgaagagtgaattgagcttcatggaaacactctggcatttgctgataagatcgatggaaatagagtattctcagcccagccttgtggccagccttcacccacatttttttcagtctcttgtcccaacaagcatgacccactttggactgtgctggtcagaaccaagcagcagcatttcctttaggtcagagagcgagtctagaaatgagatacaaacaaccctgggtggaaatgaggggtgacccttgcccccccttgcctagtggcctcttgtggaacctacggggtaggaatgaaagtggcctgatgttgcacgtggccgatgatttatcatccctctggtctcagaaaagattgctttgggttcaaaggaaagaaagaaatgagttgtctcttcgggggttttgttgttattgttgtttgtttgtttctgtccaaagctgcttcatttttaaagctcttgttgcagccagccgtttttctgttttggattttcccgagtcggctgtgaattaatgtcccgtggaaaccactgcagggctcctctgctgatttctgtgggctctgcaccttctcgctctgccctgtgaattctgctcactcccagggactctactccagccccattggcccctttcttgtggccctgcagcgcagacgtgattgagcacaatcacccacaaattgcattgcaaatggtgcctattttttccagcagaccatctgctggagtcaattactcaccattccaagcgagcagcctgggcagatctggtgactctgcataaagtcacttctgagtcacctcatcccaaactcgcacctgaacgtccacctcctggctgccaaagcgactggaaaattacagaccctggaggtctggcttccttcctttgtcttctcctcactgacctccacaggcctctgagcttctattggcactgccaaagcttctgaggctgtgagacagacgcagaggggaaggggatgctagaggcggctgttgtgcccctagctttgcagatcgggactcaagaacacacagcaggactggggctcaagtccagtgcaccagggctcctgaattcatttttccctgagcactgctctccatactccgggatgcaccagagtacaggaggtcaaacccgccacagggtttgtatttcaggagactctactgagatgttcaggagtctgcagcagactcggcattgccttcggtggggggctgtctgctggggagtctgaccaaggcaagatgaggaagactcacgtgacaggggagcgaggctcaatgagctgcagcatccccatcagtgccatgccagatgccacagacatctgggcagggaggggcagggcatgcaggcacatcacaccctcagccccactgcccttagagcctggctcctgctcccaccccaggaggatcatgggcagcgtgcctgctgcaggcctctgggcttggctgtgaaatgccaccatggatgacactgacctggcgctaagccccccttcatgaaccctcctcccggccagctggtctcctcctggtgcctcccgcagaacctgggaggctgttgatgtgggctgcttcttccctgtctgggactgtgccctcctgtgggcagtcagcccttggcttccttccaatttacattgttctgttgcatttgatgccctcgttttgtttttgcaatgtgttttcaggcttcttaatcacctttctacactacaggtacatagagcagatttatggtacgcacctaataatagcgagttgaatgggactcatgaattatattaatcattattttagaagcaaatctagagggaattagtttacactatatatagacccagtacaagacagaaccccttgacctaagagctgttcacaatgaaatgggttctctgactggttacccttgggaagtgtattctcccaacgtgttgaaaaaaacgctgtagaaatttcccctctagaatagatatcacaccctacaaaactcatctgtcgttaaaacactaaccaggacactgatgggctaggaaggaataatgggtgtttctggttgaagcccaaaagaatcagtctttcatttcagtccttctgaagatggatccattttggttttctgccatgcatagtgagcttgtacccttcttgtaagaagccacacagagtgagcttgcaccctttgtgtgctgcaaggagcatgctgggcctttggactcattatctgaggagggagctctgtgtgtgcgtaaatccctggtctgcttttgggcgactcagcctctgccagagttcactttctcatttggttccgtctgcatgggacacgcttccatgtgaatttactttctccagtgctgtttttcaaatcatattaagtaataatcaacaatagtacaatcatagttcaactcaaaaggacgtgttgggctcatagtgctcaaatgtgtgcaaagaaaaaaaaagtgtttccagacgattagcatctgtttgattgagctttggttaatggggttttcctgtgctggacttagtcatcagcatcagacatttcttgagcccccatggaatggaagcatgtgcagaacacagtgaaggttcctcaaaggttgtagcagataaggggctctgcagggactcgtttctttcctggccacctcatgttcctgctggtgcagctccaatttccactcacttgttactattcacatttctctactctgttttcccttagaggagattttgaagacacacatcgcacactggtggtctccggatggcacgagactcgcctacgccgccatcaatgattcccgtgtccccatcatggagctcccaacttacaccggctccatctaccccaccgtgaagccctaccactatcccaaggtaggcaaagggacaccgcacagcaaattctttatattattcatgaacaccccaaccctgctcactcagtgtgcagacgtgatcatcagacatgtgtatgagcaaagcagttaacacaagaaagactaatcatgtctcattacattgcattacattcccgcctctgttgagctgagtcattggcaggtttacttcttttaggtaaccgaactaatgttcatcacctgactcagcttcactgaaccaaaacacacagggtacctcccctcaccactccccagtgatgaaggtgcacctgccctctctcacgcatcttatttctactttgagtttggcctctgggaaggcagaaagacttccatctgcccctggtcccctgggtctgggcaaggctgttttgttcatggtcactgctacgggctaaatgtttgtgtccttgccaaattcatacattaaaatcctaacccccaaggtgatggtattaggagggagatcactgggaggtgacaagacatggagggcagagccttcatgattgggattagtgcccttatgtatttgtctattttcatgctgctgattaagacatacccaagactcagcaattgagaaaagaaagatttattggacttacagttccacgtggctggggaggcctcacgatcatgtcagaaggtgaaaggcacgtcttacatggcggcagacaagaggagagagtttgtgccgggaaactcacctttttaaaaccatcagatcttgtgagacttattcactatcaggagaacagcatgggaaagacctgctcccatgattcaattacctcccaccaggtccctccctcatcttgggaattcaagatgagatttgggtggggacacagtcaaaccatatcaccttataaaagagaccccagagagacccctctctgattccaccatgtgaccatacagcaagaaagcgtcctctgtgaaccagaaattgggccctcgccagatactgaatcagccagcaccttgatcttggacttccagtccccagagctgtgagagatacattgctattgtttgtgagccagtcagtttatggtgttttgttacagcagcctagaggggccaagacagtcatgttctgacccaatgagccagtagaacagcaagtgtccagtggctgggagggaatattggggggaacagggatatccaaatctcactttattaccaaatcaaagcatcccagtgtgagtggagggcctgatactaaaacctccacagccactcagctggagagaagccagtgcccgagtatggacacagctcccatggacacatagagtctgccatgctggcttctggcttcactaggcttctccaagacccctgggcttggtggaggtgagcagtttcctgcctgcaccctgcctggtgactggaggctcacttcctgccatgagctgcctctgccagggggcatttaaacctcagcatcctagcccaccagagagctctgaaagctgatggtatgtgcctgctctgccataatcatccccacagaccagctggcttacagtttgcagcaagaggagtgataacttataaggcagatatatgaggccagtgaggttcccagagtcacagcctagagaaaggaaacacctggtgtcttagtcagttccagctgccacaatgaaataacacagacctaggcagcttaaacagcaggaatttctttctcacagttttggcagctggaagtccaagattagggttccggctgatttggttcctggtgagggctctcttcctggcttgcagacagccgccttctcgccatgtcttcacatgaaggggcaagagagggctctggtgtctcttcctctccttttgtggacatggatctcatcacaagggtgccaccctcatgaccttgtctaacctcaatcacctcccaaaggtcttacttccaaatagcatcacactgggggttagggctgcaccgtatgaattgaggaacttgttccatccatacacctggtaatacaggctcctttcaacagcctttgatcagcatggccaacatctaagagagccccagaaggaagaagaatgagacccttatggccacagccttcctttctgccttttccaattctgagagcatctggatgttaacatggcatggatttgccttcgacagaattatttcactcctttttcagctaaccttgattggtcttagtctgtagcatgtggaagggtccagcattttagttggaagcataattaaatagagaaaagtgtatgggactgatgctagttccttctaacccttctacatttcttaccagctgttcacagccaccccacccgccagaagagctggtggctgtctgaccttcatccaacccagagatgaatggttcccatggttatctttttgtgggagtttccccagtctaggagtgataacctggaatccagtagggtgcccttgattttacagtgaactctcagaaggtgctctgaagctgggattatgaaatcccagattactcaagatttggggtttcatattttaatagaaaaccaacattctggctgacagaattcagatgctccttgccccattcccacccactcctaaatcagaggcatgaataggcaagcctgcctgacatgccctgtcgtgggcctgatagcctctgtaaacctgaacatcttctgcagggtggaagtgagaacatcagacaacaccccgaagtccccctaaagaggaagccccacatctctccccagacccatacttgtcccccagagagtggggaacagggaagcagaatagtgccccagttcctttttgaaggacttaatctctccccatgctgagcatggccaccgctcctcaatgtccatcatttgctcacctccaactctccccttcctggcatccaatccatcttttctcccccactcctcttctcgtcttctcttttaagcaaggggctcagtactcacttgacattgccaaaccggggagttgggtggaatgggaagcggatgggattctagaaaagcaagaatcagcccacttagccctttgtccttttgaaaccctacacatgaaccatttgttctccacattaattctgctccttaatatggagctccagtgtcctggagtcccacctcggaatctcccaggaaaggctttgcagagctgaagttcactcttgtataaggctgcttgttcatgtctctgcccctttttaatccccaggctggaagtgagaaccccagcatttccctacacgttattggcttaaatggacccacccatgatctggagatgatgccgcctgatgatccacggatgaggtttgcttccttctattatgttaccaaaaaaaaaaaaaaactaagatgaatgttcaatgtgcatggtctcttctggatcagatttatcttacaacaagtttaaacatccaagaaaaaggtacctttcctaaagatttcctcactgctttatgattccattttctaggaaaagaataccattcaccaagtactattattttttaccttaggtcagatgcaggttatcctcctgagagctgggctcctctgggaggggcatggctgggccccaggcctgcctcagggggacaccagaggaaatgatgcggtcttcccaagacaatccatggagtctgaccttccataaatggtgctctgtatttagagcattttttagagcatggagcaatttgccagtggcaaattctattctaataaagccacatctcccagttggtaaggtcgcaaccctgtggaaggtattaacaatgttattgagttattattattagcatctgattgtggtcgcttttttctaaatcaaaacaactgatttaggatcgaatgtagtgatctgaatatcagtttagtattttccccaaattcaagcagcgtggggaatgattatacttccagagtccagctataacatcatcagccttctctctgttaaggatattgatgagagactcaaaaagaggaggggattttaggggtgccaggacccacccaagtatagattctgaaatttcatgaatggcactatttaaactaagaataactcattctgaggctcagcaaagacccaacccatattttgctatacctccagcctgggcctttattattccattcaaagctccatattactagtagcttctggcagcttctggaaagggcaggaatcgaggcctcaggtctagctcggggatggatgctccagcacctggtgactctggacctctctgaatgatgtgctggtctcctgcagtggctccagtgccacctttgccccacaccctgagctcctgcacagaagcccgaggcctctgcagaattctactgcgattccttcccctcatctttcttcagtgaaacttataatgttgtaagatccccaagtggatggatgaagcccagaagcccagtgctctaggaagcgtgaggcactgcctgcccctctcagccctgcatgggtcttctccccaacataggagggcctgtggctctagaggtttaatgaacctggcccccagcagctggtcccagggacaactggtcactggggtatcagcccaaggtgtgcgctggtttggagagttgaattgatttggctggtgatatttttgctgagatttaaaaaaaaaagttcagatgattgctttggcttttctcctaaagttccatatattttattgttttcctttcagcccccatccctgccaagcctcctggggcctggtccagcaaactcactgaattaatatggaaagtcacctggaaaatttcagccatctgtttgagttaattgaaaatctcgtttagtcaatttggtgatgctgtttccacaggcttgattagcttcaaggacaatgaaaaattagcgtcagccaggacttgaagcctggatgctgggcttcaggttttctggttgctctcatttcctaagctcaatgcaataatgcattttatatgcaatgtaaatttgtagcatgtaaatgtcacactttctcatactgcttctctatcacacatctttgagagtttttaaaagtccacacagatatatcagaaatcccaggctcaatgtagagcagatgtttagtatttgccagccatttgcctgagcactgggaatttggtggcaaatgaaccatggagttcacagtgtggaggggaacctggatcctgaagaagtcattactagcaagtaaatccctgcaggtgtgagaagggctgtggaaacgtgtggaagaggaggccacctggtctggagggtggcagtgtcacggctgaggtcagagtttctgcatgtccatgctactgacatttggggctcagcaattcagtgctgtagggggcagtcctgtgtgccgtagagcactaggcagcatccctggccttacacattagatgctgtcatatctgccttttccccctccagttgtgaccatcacaaatgtctccagcattgcccagtgtccccagattgaggactactggtttcaagtgaaggttctctagccaactgcctgggttcgagttctggctctgtggactctgtcaagttactcagcctccctgcttcagtttcctcatctgtaaaatggagataattttaataagaaacatgtttactctcgtggacagttgtgaaagttagatgagataaggcaaggatcatagggctggttcctccaatcgttccatcttgtggctatacataccccttgtatgtggacaactctcccctgtgtacctcaacctggcctgggtcaggactctaggttcaaaaagccaaccacccaaccagcatttctactgggagtggtcaccatataatttttaaatggtcaaattgtgattctcagacaaaatcaatcaacatgtgtccaagactttattaaactcattaattaataagggaaccagtgagctcttaaaaagaggccatagaaccatcgagaagctagttgtatagaggcaattgaacaaggacatcctagggtgagtctgccgggttactcagccatccgggagagacgcctaccccagcagggttgagaccgcccctgcaattggaaatcaagcccagcatgtccctggagaagggcccagtgatcccacctgcctctttaccaccttcagatccatttgctgacactgtctacacagcatctcaggccgaacccggtcaaagccaacctcccactctccttgtctacacctgctccctgcagtctccccatcatggtccagggcaactccaccttccaggatccccggcctcctttacgtccctctgtgctggggaccctccttggcaggtgcctggcatcagcctgcaaccccccgccgttccccactcctccctggcctggcccaccagcactgccccctcctgccccacccactgctgaccccacacagcagccagagtaaccctttaaatgacatcaggccacgtacccgctgctcccagacatctagtggcttctatttctctccaagtaaaggccagacttcctacagtggcctcagaagcccccatgatagatgatagatagatagatagatagatagatagatagataaacagatacatagatagatagatagatgattgatagacagatagatagataggccatgcaccctttctatcccccctcacatcggctgggtcactcccatacgaggatctgcacagaggctcccctctgcccagagagctcctccccacttaggtcctgatcaaatatatggttcccacagtgacttccctgataaccacatttcacatggcagccccaccccgcttccattttcttccttcaattcatcccagtggaatttttagatacttttttaaattgtttcattttcattttcccgcctgccacctagaacaggaagttgttgaggcagggacgttagttcctgtggggcgggccctggctccagttctgcagcagggctctggaaccttggctggatggatgtattgacttcaaatttagccggtaaaatcttatttgcatgggattcttgaagcttgagatatcttcagttgtgctggtacctttctaagaaccaaaacttacttgctatttagccatggatgacatcttgtcctctcaagcacaagatgctaaaggaactaactgaaactaagacacctcgtctgtggagggacacaaaaggaatgaaccctaagccatgcccctgagcacctaggaagggagacatgcagaggtttctggaagcctgcagtttatttcagcaggctagctcacgaaccaagaggaagggagaaagcagttcatgtatctgctatctaacctttatgccactcattttcaattattttttcctgtttgtttgcttgttaactagattgacttctccgatggttctcagatgcagggagagttaagtctgctctttcaaatctttgcattggcaagcacttactcatcatccatgtggcatgtgctgtgtgaggcccttgggtgattaagacgtgtggcctctcctaatgagagctcacattccaagaggcctggacagcttgtagccagagtctgcatggaagtgtggaaggagccacacctaggagcagaggtgccccttgtggggtgagtgggaagtgttcaggatggttttgcagatgtcagaaggatcccggggcaaaattggaggccctcttgggaaacggttctattaaagagaactaagagcggtgggcccagagtagagctcagccttccttgggctaatgcagggacccaggccttgttaagctgaacctgaccaggaaagaataaacactgtctatcctgtgggtggaaaaaaataaatgcaaatcgctgtgctgtggtttctatgctttcacacagaaacccagctgcactgataaaacaaatgcgcttgttttctgctggtttcctccggcctttcccgagcagttgagctgcgtgttgagttaagatgcggcagatagccagcacgatcattctgaagacatgttgccctgtgctgatatgtgctgttatttgcctccaaagatcctgtttggatgcagcgcagctgctcttctcctgattccctggcaagcagaggcggtaaagggctcccagaacccaagacacaaaaccaaccatgtccctgatgcacctgtgcgcagctgtgggggctcactcctccaccacccgcttccacggctcacgaaaggctcagaggcctctcactttcattttcttttgcttccatttatttgttttgatcccaagcaccaaggatttagatgctgtgcagctcctggcacagaagcatggtcggtccatgcaggcctctctcattttattgatttgctctttttcaactttagtccctactcccatgccctcgccacctcataggcacttatgtcgaatgcttagaggacctttgttcctctgtgtttttgtaaagcctgtattgttgcttgggtatgtgcgcgcttactttacatcaatggcattgtgatagagagccagataagctacaggatagaaacagatagagctccagacatagatgtctgtttctcctattttcctgtgagcaccatgtggagacctagcacacccatgtgtatttgaccaacccacggtttctaactgcacacagtgatgccagatgcccccagctcctgggcagcttacaacctcatggccttctctgcctccaggcttctccccaatatgcactgcccatgacacctccatgctgaccctgatgcgaaactcagccttctctctttccaatttatacaaaacatggtatgtgcacgagttttgggaaagctgagggtcatcagggccatgaaaacagcacagaacaatagagttctcatacctaatggcttgagcacccccccccaaaaaaaaccaccaccatcatcagtaccacctcttccccaaccttcaccacctatacaacctccaccaccaccacaccaccaccaccacaacctctacaacttccaacaccaccttcaccaccagctccaccaccatcaccaccaccacctctgtcacctccacaacctctacaacttccaacaccaccttcaccaccagctccaccaccatcaccaccaccacctctgtcacctccacaacctctacaacttccaaccttcaccacctgtacaacctccaccaccaccacctccacaacctttacaacttccaacactacaaccttcaccaccatcaccaccaccacctctgtcacctacacaacctctacaacttccaccaccagctctaccatcacctccgctaccaccatcacctccatcacctccacaacctccaccaccagcaccccaccatcacctccaccaccaccaccacaactacccccaccatcaccaccatcacctccatcacctccacaacctctaccaccaccaccacccccaccatcaccaccactatcaccgctatcaccaccacccccaccatcatctccactacctctaccacatccatcacccccacaacttctaccaccaccaggtccactgtcacctccaccacctccatcatctccacaacctctgctgccaccacccctatcaccacctccaccaccacccccactactatcaccaccacccccaccatcgcctccaccaccaccaccatcatcacttctacttccaccaccaccactgtcagctctcacttggtccctgttgctctccattcttaggtctcctctgcctccttccctatcataaacaagctctcctgcctcacatttacaatgtcaataacctgtcacatttacaatgacctgacttgcctatggttgcacttttaattagtagtagaaccaggacttgagcacgagtcttccgtcaccagagctattgctcagcattgtttaagagctgtcacgcctactgtatttccctttgtgcttgaactttcaggtggcacaaagctcatttggagggtttgctggcaaaatctctgttcttcctgctttcctccctcaggctgtggtccatctggatgttggggttgttcagacatcttcaggtgattcctaagtgtggccaaggcagagaagcccttctcagcagcagcattttacaaattatagctatgcccaacccccagttccaccccatccctgagtctgccatcttacctaaacatagtcctaacctctcttttgtctgggaagatatattattttatctgaatttgtgttccaattttttttggacgtggtctggatgtaaattacaatttcacaaatgtgctctgttcccctcacctgtagtcctatctctgttttcaccttgtgtgttaaagaaatcatctggctacctaaatactcaaatggattcatcttagggggcaccagttcaaggagattggctccagcagacagctttgtttacagccttgtgctttcagaatcagaccagggcagggtctttgttattcattagggtgagaagccattcccagtgactagggtaatggagaagctccagactagagaaatgccggatctttactgatgtgctgaaaaggaaattcacaaagttcctgttgatcatgggatcattaataaaaatgttcagtgctgtaggaggctggaaatctgagtcacagctgtcagaataataagtttctggtgaagaaagtacattttacattgtcatggcctgtgtttgaaagggcagctggattgttctgaagatgctgtaaatgcagggaatgattggttggttggcaggcttataatgagcaggagacatcagaaaaataaaatgggattctgcgtcgccatcctcatcaataaaacaccttagccatatcttccagctagcaaaacagtcttgacatctgaaattgtcagtaaaacactgaaacactggacaaggtttgccaaggcagagtcactgggctggtgagccagtgctggtaaactccaagggtgtaagtgacatccgcagtttcttcccgtggaccacaagtagcaaattcagtacatggatttcatggcatctgcaggaaaatgagacttggcaaaatttacctagcatcatgtttttaaatgtgttaacatgcattgaggcatgagcaaatattgaggaaacaggttgagtccatgggtgggtaggtgggtgatgaatagatggatgggtgatggttgggtgggtggagggatggattatgaatagataaatgcatgatggatgggtaaggggatagatagatgaataggtggatagatggataatgaatggatgggtggatgaatagatggatggttgatggatgagtgaatggatggatgatgggtggatggacggatagatggatgatgaatatatggatgggtggatggatggatgatggacagttggatgaattaatggatagagggatgatggatgaatgggtggatagatgaatggatggaaaaatggttgatggatatatggatgggtgagaggaatgaacagtagatggatggatggatggatggacagactgatggacaaatagatagatgggtgctgagtgtgtgaaaatgaatggctgggaaaaggacaacatggctttacccccaccactcctattcactgggtgtcttcatgttcacagcattaaattgttgaaaaaggatgccgcagtccctaaggcgcgttctctgtgaccccctctcacttcgttctccctcatcctgacagctggccctgcattatagccagcccttgagatggaagggacaggcagcatggtctattcctacatggaaagtgaaattatggaaacagacaccaaatagtaatttgtcttaagtcgtcacttttctgtgttgtagaaggcactctgccggcagatgtttttatgcaactgcatggctgcccgagagcatactcaaatgtggaactgtacactttagtagagcagcgcttggtatttagggtcgtttcagtttgctcagcggtgccctctattaaagcacatcatcttttaaaatgtcctctctcataacatttttgtacccctgctcaatccatgggataaacattgctaaaaaaataccagagttaactgtgggccctttatttcatgagataaaccagctttgttcccctcgccctttactgccacacaactgtcagaacatttgccaggatttgcaacacaaagaagtatcacagcacattaatccttgtgacggagacaatgctctattaatattttatggcaaacaaatggactaataaaaaattgatatgcttctcaccaggaagagtcactatattctgatttgaaggcacctttggcctaggactcatggaatgtaataacgtttcctcagccaggctgtgccattgcatgtgctcccccacgtaatccatggcagtccccaccctgtgctgaagttagtggcttgcccatctctgcaccgtccgcacctagaaccgtgtctcccacatgccaagccctgactagatgcgcttggatgcatcagtgcattggtaggcagatatagtgctttagaataaagagaaatttggtagcatttcttccagctatcttcgcttcctgttcatattttggtatcatgctctttttaaaatggaattttgattattaaaatatgaccatctattttctgtgattatcaaaatgcttcaatatctctcttcatcttggcagatagattattgcgtcttttagcactcagctccagccttatgttaaaaaatgattccacttcaaatcctattttctcctctcctttaactgctaccaaatttctctttattctgaagcactttacctgcctaccaatacatttacccattcaaagaatatttagtaagggcagatttggaaatggagatctatagttaaatagcgcttggagttattctcatgtggtcgcccactgccagacagaggatcgctcgtctccaatcagtagttctccactcgagctggcactggaatcacctagggccttgttaagccaggaagtgcttgtccccacccccagagtttcagattcagagggtctagggtgaggcttgggagtttgcatttctttttcttttttattattattattttttgagacagagcctcgctctgtcgcccaggttggagtgcagtggcatgatctcggctcactgcaacctccgcctcccgggttcaagcaattctcctgcctcagccccctgaatagctgggattataggcaactgccactaggcctggctaatttttgtatatttagtagagacggggttccaccatgctggccaggctggtctcgaactcccgacctcaggtgatccacccacctcggcctcccaaagtgctgggacatgcggttcctaacaccttcccaggggctgctggtacaggaaccacactgtcagaacctgacttgcctccttagagatgggggtagaggctgtttccaccacctgctttctcccctaattgcatggactttgcctgactttgccacaaaggcctcgcatccccatagctgtcctgctctctctgggtggcctgacctccctgggcgagggtgacaacactgcctgtgattgctgcgaaatcaggacagctcacacaggacgggcagggtcttctctcgtctctgcccgtgcttccttctaggcagcagtgccttctgagtacagtcatggtggtgccaatgatgtccctgtatgacacgagatgtgtcacccatgcagacaccaacaggtttacagggagcagcgcgggtcagtggcgtgtggcattattgcggctcgctgagcagtgggcagccattcccgcagcacaggattctgctctccctccacttccctttgtgaggcatggacgcctcccatcagtccaacctgttctcatgactgtgccttctgttgacgttgagtgttctggcattataacgttcctgtagagtctccctctgatcaatgcttccctttgtcccctcgagagacagtcttactcggggcatgggaatttgacaggcatctgcaggtcccacgccttgggacagaacacacatgagtagaagcacttccttctccttgctctttgtctcaaggagctccccgcctggccaacccaggactgtgaggaagaatggtaaggcctggaccttgtgagggaggaggcaggaaccagaagggctggaaaagggcacaggacaggctgacaaacatggctttcttggaggctatctcttcaagcctccaagaggagctttcttggagacagctcttctctgccctattttcatcattttctataggggcaaagacacctggggaactgcacaaggaaaggagagttttcggctccagcttgagccactgggactttcctgcttggagaaggttgctgcaaggggtcctgtgtgtttcattgcctgtgagcctcatgcccaacatggaacctcctgcatggcgtgaacagtgcacatccaagcttcgacagcagcctctggggagggaattgagctacaacttgcactgtgaacacgccattctcctgggacaagaggccctcataaggagagagacctaggacaagagtgagccagacctcggccccagctgtgcggacacttgcctgaggaaaaccttaccaagcccccacccttctgtaaaattcagaagtcacagaagcttatccaagcaaagcccgcagagagctcagcacaccagagcctttaacactcaagcacagttttctgagaaagaaacacttcactgttaaatcacagcaacgtacttgttccttcattttttttctaaaaggacaggaaaaaaatgtacactcagtgagctgatgtagattctagttacagggcagtctggtttttgcttggtgagaaagccagctcaagtattggtcactgttgagaatatacgtgagacccttacctgttccgagtttgtgaggtcagccaccaccatgcccgtcacaatcaggcaggggtgactctggagagctccatctaggctccctgaacaaaaagagcaagctctcaggtctgcagcagattctgtgtgtcctatcaccagctccctacctcagtccacagacccgtctaatctgaccttgccaccttcatgaagacttaatcattcccatccccttatcagatgaatgggtgggcattattaattaaatatcctactgcttctgtgccctttcctgccttcttttctttgaattaaacttatttcttgaggagcttgaaaaaaaatatcttattcttatgaacttggtctggttggaagcatctagagcggctgtgatcaggtgtgtggggaaggacatctccaccgtgtaccagtgagagctagccaataggttcagcctcattcagaggcactgaaatatttctccatgacaccgtgggtttatttattgttgttgttaagttttatttagttttaactttgcttttcttttttatcaaagtattgcatattagtgcttaaaaataaaataatatggaagagtctatagtgaaaaacaacagtctcttccctctccttctaacccatctcacccccagatggagatgacttttcactctttttacactttctcctgatatataccatcctatatggtaaatcactaagcaaaatgcacatttcactgtttttaaatgaattttagtcttatttattgtctttttatgatagacaagaattcggaacacttaccttcctacctattctaccccctccatttatatgtggattttattctctatgtcagttacctttttacatttaaatactattacaagtttgttcatgttacattaactacagagaggagctcttaacttcccaatttgtaaactgagattagtcccccgccctttcctacaagtccctttcctgtccctaccacacagcaacttctgcatctttgtttttacttttacatcattgaggttgatggcatttacactctgtcctgtaatcataactaaaccttccttacttttccattggttgattctaaaagattaaaatcaataaatagcatttactttctcataactaagtgattatctttcatgatagagctaaggagtgccctgtgattgcaattctttttgtttcactttttgttttcctggagttttaaattgtttttgttttttacctgaaatatttaattttattacatcctctctctccttttttcaaatcctctcagctattctgttgcattgcccttttccccaagtctgtctctctgagtgccctccatagccctggtattgtctggactactttttccaacctctacactaaggccatcctgggacctccccacagtgctccctcatgttggggcaactgtttcctagatctcatagatcacgtgatttactccctcttttgtctggagtgcattctcttaatgatttactaagaaaggagtgcaggaagtaaattttctgaattcttgaatagctaaaaatgtctcttttttcacacatttgaaattttagctgtatgtagaattgtagtgtttttattaactctttattcgtcaaagctagagggtatagctccattgtttccagcattttgagatgctaaagataaacctcatgttggtctgtgatatggtttggctatgtccccacccaaatctcatcttgaattgtagtttccataatccccaagtgtcgtgggagggactttgtgggaggtaattgaatcatgggggcagttactcccatgctgttctcttgatagtgaatgagtgctcatttgatctgatggttttataaggggctttttcccctttgctgggcacttctccttgccaccatatgaagaaggatgggtttgctttcccttccaccatgattgtaagtttcctgaggcctctgcagccctgcagaactgtgagtcaattaaatttctttcctttataaattacccagtctcaggcagttctttacagcagtgtgagaatagacttctgataattgttcctctgcaaatcaccttttttctttccaaaagctttttgaattttgaaataatatatctatgtgtgtgttttcttttcacttatcaccgtttcatccatatactttcaatcgttcctcctgtttgaactgcatttctgagtctcatacgatgctttacctggagctctgagtccccatgattctctctgaggtttcagctctgcaagtgtccaggttgctgtgccctccagcctgactcatccctcatgacccttctatctactttctgtcttccagaaacatgaaatctctcagccctcccctgttgtctttattattgtacatatattttatttctttattatcattgcaattaggtttctggagggaaaacaaactaatgtgataaatctactaacttaagttggagacttccagtgttttcttaataaccatcttcttgtttaaaaagtaacctatgcagtatggaaaataataatcccttgtcattgcacatcacactacccgtaggtaactactgtgagaaatttgataaattatcctttgagatttcttttctggaaatgtatatttgttcttcatttatttgggtttttttaaaaaaatgattaagccattttcccaacaccatcgattgtggaagtcttcctttccctactgatttggaatgacatctttattaaatgtaaaattatcatacaaaccagtgtgcattaaaggtgcctgtccactactgatggttgcctcagtcagatgtcaggtggttccagaaatacgcttattattagcaactttaaaaaataaatcccctgtccctatgcttcctttttaaaaccacctatctatttcttcttatatgcgaacttcagaattattttatttgactctctactgaaaagaaattcattggtttgctattaaaattaaattcatttctttaaccaatattaagtatttaccatgtgtgaagccctatgtaaggtgctaaaaaatgtacaaatgaataaggtgggtatggtctctgccattatgaaggttaaatataataaattcagttctttccaaactgatcaccattttgaaaactttaccatgtcttttctcttattccagaaacataggtgtttctattccttttttctaaataatatccttccatttcatcatgtgtaatgctgctatgttttgtttttagccttctttttgcaatttactaaatgcttatgatcctacaaactatttgcccagtatttctttatattatttttatcacttaatttgaatttatcatcaaattgatagtagtttagaactagctatggatgaactgattttagagattacttttttttacatgttgagtttttaattttgagccattaattttgagttgccttcataagtcagtgtagaatatattcaagtaaaagataaggccgggcacagtggctcacccctgtaatcccagcactttgggaggctgaggctggcggatcagttgaagtcaggagtttgaggccaacttggccaacaaggcgaaaccccctctctactaaaaatacaaaaataagccgggcgtggtggcgcacacctgtaatctcagctattcgggagactgaggcaggacaatcgcttgaacccaggaagtggaggttgcagtgagctgagatcgtgccactgcactctagcctgggtgacagagtgagactctgcctcaaaaaaaaaaaaaaagtagaagatacactttaatacaaaaatatattggttgttaaaaaaacacattgaaatattaaacattaagtattagcaatagacagaaaggaggagaagcttcagatcagcctaaattttgatcctttgtcaaaacttatttccttattactagattattgtggaatttcggttttcccataactcaaaggttctagcacaacatatttagatgtttcattattttccctggaatgtgggaaatcccttttagtcttcacattcgggtcttttttcctacacagaagtttcgtcctctttgtctttggttatcgtgtctgtagccactctggtttctctgtagaagcactgctcttcccagccggtaggaaggctcatcttcttctttacacctccatgtcaccttcctctgccttgtgggagaacctcccacattttcctcaattttcctgacccaaatttttctaattttagttttagtttccttgcagccccctcatctccctttttgatcttatcttggacttttagaattctgttctctttatttttagtgtgacttccctttcctttattctgcaccatttgaccctcacagttccgcacctcaggaaggagaatgcctcccacacctgatacctggccacagacaaagggtgagagtcacctttgactctgtgttctgactttttaggtgctactgagctcttctccggtgtaaatctggaagacagtctaacccatgtgcatctggcatggatcgtctgggctgagttgacatttttttttctaccttcttaagaatttttctttgacattctatgtaaattagtacacatggaaaattacaatcttccttaacacccatttagcaaaggtttgactttccaaatctgtggctggtgtgagcccagcatttctgagggaagaatagtacagtggggaagagaaaaaccttttccttctgcgttctcatggctggggctgccctgttccctacagggaagaaactgggcaagaccttgtctggtttcaccagtgccatctgtgttgcagttagagattttcaacattcatttctaatggcattgtgacttttcatcatttctgtgtgtctctttagacatgataacacaaagttagtaaaggtctccctctgccggccaggcaccactgcttgctggagacctctgtctggagagtccacactcgatgtggtgtatggtgtgctgtttgtgagcaagtaaatgttttattttcccttccagcagcaaaagtgtgactacaaaccttatagagcaaaagaatgtccctttgtccaaagcgtcgctgcctcgcaaggtgcctaccttgtccccagaaagctgctagaacgccttcaagattgccctgttggtggtgatgcttcaccctcgtacaccgacttgatttttagaaaataactaaaatgtatttggggccaggcacagtggttcatgcttgtcatcccagcactttgggaggccaaggcaggtggatcacttgaggccaggagttcaagaccagcctgggtaacatggtgaaaccccgtctctactaaaaatacaaaaattagccgggcatggtagcaggcacctgtaatcccagctatttggtaggcggaggcatgagaatcacttgaacccaggaggcggaggttgcagtgagctgagatcacaccactgcactccagcctgggcaacagagcgagactccgtctaaaaaacataaaaaatcaagtgtatttggcaccaggtatagtcactgatgcaactcatggacttaggaaatgttgactagagatgagatgttgctatgcgggtcatgaggcaacatcaagctctcagggcaagtcggcacaaggggcccaaaagctttatgataaatggcaacaggattagaagaggcaaagaactgcccaaaatgtgagaatcacggcttccttacatagaggtggagcccttatggatgcatgtatgtaaaaagaaatcttattatataatctttataaattccattaatagtgtttattgttttgggtttttaaaaatatttcacactgtatttcatcaccataacatctctaagggtgccaccaggctttaaaaattcatattacacaaatgaagaaactgagggttgaagcaccgtatagaattaattgtagaaccaaggctttctcaggcctctgaggtgagccacattctgcccctcaacccagggatgagccacgaggcagagtgggtccacatttaactgtcctaatttttagtacaattatatttttcctcagtgcaacagcctcatattacaaactaagagaagggaggaaaggagggagggagggagggagaggaaaggaaggagggagggaggggaggggagggagggagggaaaaaagagatgatctagcactcactttatgtaactggtcattttacttggggctctgtattagtcagttctcacactgctaataaacacatacttgaggctgggcacggtggtccatgcctgtagtcccagcactttgggaggccgaggctggcagattacttgaggtcaggaacttgagaccagcctggccaacatggtgaaaccccatctctactaaaaacacaaaaattagccaggcatggtggcagacatctgtaatcccaactacttgggaggctgaggcatgagaatcgcttgaacctgggaggtacaggttgcagtgagccaagatattgtgccactgcactccagcctggggaatagagtgagactctgtctcaaaaaaataaaaataaaaataaataaataaaataaagacctacctgagactgggtaatttagaaagagagaggtttcatagactcagttctacatggctggggaggcctcacaatcatggtggaagacgaaagaagggcaaaggggtgtcttacctggtggcaggcaagagagcgtgtgcagggagactgccatttataaaaccatcagatctcgtgagaacttattccctaccatgggaacagcatgggggaaaccacccgcatgattcaattgtctacacctggccccgcccttgacatgtggggattattacaattcaaggtgagatttgccggggggacatggccaaaccatatcaggctctgagtaaagaaacagtgtggtggctacttctagaaaataacaaaccacaccagagtaacacatccttgcctccttctaaagccatgaagcaggcttgtccctgtgtgtccacgttttgtggccaagagctttaagcaggaacagtactgtgactccgcgggccatgtcactgctgttgatgctgcacaccccagccccctggttccatccagtggcactcagcctagtgacatttccagcacgatttgttctggaggcatcaagagaaagtttgcatccatctcattttcatttataacatttcacttccaaattaagaaatagaaaaactaagaatagtgtgtagtcatatttggcctagatgaagattatttgtacaaaagaacactataaaaagcagaaagaagcataggatgaatgaatgtttccaacaattgagaacaaaagcagcattcttcctaattagcatgaaggacatagagggaaaaaatagtcattccgggagaccttacattttctttcttgattgcatgcagacgaaatgtgtttgctgagagagtaagtgcagggtaccctgtggcttcgccactgcccccattgtggacatggaatcttgcaaccacaggccccatgtggctctcacacacgtcccatggtagggaataagttctcatgagatctgatggttttataaatggcagtttccctgcacacgcttcagcgtcctccagtgtggactcaaagaccagttacaacatcattaaaaaataaaagtgttctatgtaaagcaagggctaggcagagacgttgaattatatttaaggacaaaagtgacatatatttttttcttatgattgtaaataatgaccaaatcccatcattataaatgcctgtccctgcctttgggccatgaaacagcaaagcaggacctttgtagaatgttgctggcaggatgtgccacctgtcagtgccagggccaggatggagagcaggggggagggcatggtccctgtggacatgcaagccaggttctggggcaggccaggctctaggacgggccagtatggggagcagatggtgggaagaaaagcaaccatgtttcagacatcacagaaatggagcaggttgaaaggcacgagagctggattacagctgagcgcccctcctgtgttcacgggttatgtacctcctcaccaccccagtcctcaggaactccccatgaccacagtgggcagctgcagacctcccctcctggccatgcgccagcagccgcctgtcttaggccctcacctgcttgccgctgttccttctgtttgccacatggtcctgatttaggtcaagttattaagaaccttgattaacaagttttaattgtgggaaatgggggagatgtggcactggaatctcctggttaactgaggctccagccaaggcatctggctatagtcgtttctgttaaaataattattaagtgtagtgaggtcgctctctggctcgccaggaattgtctagtgaatgtactgctgtctttagtgataaaagatcttgtaagaccacaaagtaatcattctgaacagtagatctcattatagatagagaaggggtgaatgattgaacgcgcattagctggcttctagaacattctgggattcacctggggatggtctttttggggcattaattttctcaacactttcttcttcctcttaaatgtaaaattgtatttttttaatctggtttttggagggctctgggtgactggatgaattcccagaagccccggtacccctcgggctaagtagagagccgcacagagcctgtggtagtttcaggtttgggcagaatcaggcgcatgacccttaagatatcaaaccaagttcgcctgaagcccagagccatgaaccaatttccctaattagctagagagtgtccctgggtattttatctttaaggaggaggaattagagaatggagccttcaacagcccaggctgggatgcttctcaccctgtgtcgctctctggggcctcccgccagcccttttccggttctttctctgtcccgcctccccggacccctcgctgcccggtcaggtggttagttgtgcgtttgcctggtactgcggtgtgaaagtcaaggcatcagctggagagacgagacctcaaaacccacggagcagcccccacacccctcacccccagggcagccacacgcagtgacatgcaactcccagtgtctttgggtttatttagcaagaggtaatgactgggcggcccctcagagtcccgcgccagtgcagattctttataagccagatttcagaagctcgcaggctggctgtgtcaccactggctccggcccccggctcccgtgtcgtgtccagggctggggtcggcggtcccctggcttctgtcgtgcgggggtcctgccaagctgctcatgctgtgtttggcgtttccagggagtactacatcaccatggtgaagtgggccaccagcaccaaggtcgccgtgacctggctgaaccgggcgcagaacgtgtccatcctcaccctctgcgacgccaccacgggggtctgcacgaaggtacgcggggctgtgggggtggaggggagacgggtgaagaaccgatggtcagacgcgcccgaggtggcgccagagtcgtctcagccctcgggcctgggacttggggaccggccgcccagctgctgcggggagcccgcggcgcagagtcccggctccggcgtggctgccacctcgtggctggtgcaggcgctgccgcagacccgaccgaacccatccgtgaattgccagaggcgccccgtgcctggcacctggacgccgtccgcagttcactgagtgttgcttccctttatccgcgctcaccgctgtgacctaagtgagcgtcctcctcgttgcagctgatgctcagagaggaggggccctgcctttccccagaccccgccgacagcctcccccagcgggctccaggcgtgcgtccctccccacgtcctggtgaggccagccatgtttctaggagtctcaggccgactcagtgtgtagtgagagaaggtaaacgtaggggaaagaaaattaaaatgctcaaagagtgagcaaaggaaaaatgaagtgtaagagaggttgcccgggtggagcaggcaggcggcccacggcctcaccctcgccccatgggatgggcccccagaagcaggtcaccttgtggcgggttttgtagacatcaaataatatcgattaatacattcaggcaggcctttcagaaactcctttttgatcttaagtttctgtctcctggctgaggggggccaaggcttgcaggcatatttacttgagaggctcctaacacgacagctgtgcctgagatcctaagcacagtgattgtttctaaggtggtcagtcttgcctgaccttttatctaacctggggcggattccaggctattctgatgagcttgcttgaggggaaggaaggaacgtgaggacacaaagcaggcagctaaaaatggcttgtaatctccaacttctccatgcccctgagccttgagtgtcagtggcaaacactgcttcctgctataacccatgacagaggcctgctccaggggcccggaggtccagtctgcaccagcaccaggcccacagcgcctccaggtgacacatgtgtgctgcacagcttgagtttggtgtctggagttttgtttttcttttgtttgcacctttccatagaccactgtgagacccacttttcctctatgctttagcccctttgaaagggtttctggtccaccaggagtgttactcagtattccagaatgggatctggacacaatgtccaatgttctgactcagtgtaggctgaggttcactattagatggacacatgcccgggcagtgatgaccgccccctggtacacgtgccatcttcccccagagggttcttttccaccacgggtttgtccttgttgctagggatagtggcattttctaattcgaggacgcttgtgtttggctccgagccacgcacgagacaaagaggagagctcgggattgcctcctcccagagctgccgtggcagctgtgcaatgcttgtgcagcggccatgtaggtgaagccaaattgtttcctgcactgtcggtcacagacacaatacatgcaaaaaaaaaaaagaaaagaaaagaaaaaccctcttgtctaatgctctcatttcatttcagaaacacgaggatgaaagtgaggcctggctccacagacaggtaactactgcatgtccgggtccccactgtcacctccacctgatccaccccagggctggccctcagagcttcgacaacagcagaatggcttctcagagtaaatcacacagggctccccaggcagaaacagacggcgtgccggctccactcacggtgcctcccgttctccagggttgcccagagagctccaggagaatccaagttccagggagggtcgtgtgaaaatcacggctcttcagagcgtggaatgtttggtgagacctcagcttgcagttagatgccagcaccttgctgaattgaaaatgaacagtccatcaaaggtggcttaacataatctactatagtaaaagggtggaaaagtggtggatatccctgtttgttgccaggggtggttttgttggtgtctcatttggagtcacctcctctgtgattccgtaagacccgtcctcagggacataactgcaaaccatccctggagagtcttcatccctaactcagataaaggaacacacattaaaacagactctaggaacttgagaccaaaagagatcaggagaagcccaggtaaatcattctgagacaattttttctaaattaaacttgcacaaaaagtatcagtattttctttcttcaagcctttttgtctcattccacactctgacactaagaagaacaggtgaaaaagctttggaagcttcctgtctccttatccttcctaaggggatgaaaattgtcttaaagactctggaaaaagtcaagccagacttcagtctcatgaattatggtagagacacaggtatgcttcttcatcgatatggtggatcctatttatggaaaataactgaagctggacaaaactatcgccatggctctccaagaacattccagcactatagatgctgggctgctgcttctgcctgtggagtcaggaatataattatctcagaagtcagagcctcatcaacagacgggctgctccgaaatgtatcctgtttctgctctgtgtcaatcttattcacaagaggaatggttccacatggccactttcattttacatgtcccaatttgggtgccaagtccaagccaagaagatatcgggaagagggaagacttagggaaccctcaaacattagcatgctggaaagttcttgaatgccacctggaccaaacatataagcatataagcatacatatcaaaaatagtattgtgatgttcatctcacattagacaaattgtcagagagattacaataaaaggaacattttgtaaactccgttatctatatatcatgtgttcaaccaatatttatggatcttaccaggcaccatgctaggctgtggatttcaaaaaatgagtcggctactatcactgagcacacattgtggtgtgtgtcagaattttattccttcttatggctgaataatattccagaatatgtatgtagtatatatcctggaatattatacatatgtatgtgtgtgtgttatatgtatatatacatatatatacaatataatacatatactggaatattattcagccgtaagaagaactgaaatagtattccagtatattccagtttgtttgtctgttgatggacatttgggttctgtctaccttttggctgttgtgaaaagcacatctaataacagatacaaaaggctaccttattgtacaattccatctatataaaatatccagaataaataaactcatagacacagaaagctgatcagtggtgtcccaaggccgggggagtatggagaggaacagcttaatgaacaggggtttattttggggtggtggaaatgttttggaactagatagaggtggctgcacgtcattgtgaatggactaaatgccactcaattgttcacttttattagtacgttttcttttgtgttatgggaattttacctcaacgattttttaaaaaattaataagctagagcatgagctcttaaagatggtacatcctagacagggagatgagatgttcacgttacatccattgtgcaggctacgagggtgatcctcagacattcagaagcattgctgaagtattcgggtgttggtgggagtgggagccagaaaaagcgtggtggacatggagcaggaggccctatgccaggcccactttgtgtttgaacaggaggaggtgagggacgtgattctttgttgggggcagggaggctatgggaaagcaaggtggacatgcacactctgcttccctgtccccctcaagaggcattctcacagggggagctggcttcccagctggccacctgcagttctgccctctggatggacggcagagtgcatggtccctggaggcccatggggggccgtggttctgtcctccagcgctcacttcattagctctacagagtagctacagagccgaggtcgtcagcaggactttcctgtattagcgattgtgtgtctcatcgcccatatgagaacagctactaaagtgtggggtaagacagcctgaatgggattccagaaaccagatccttccaagcagaatccagtcaacacttaaaaggtggcatgaattaaaataattcttactgttttcaaatgtaaagtttaaagcatttactaagcacacagctaaatttttaaaatagctgcttaaacgtatgcaatgctgccatgagttggaaacataaggttctgtgacaggtgtgttttcctgggatggagcgtccctgggtcaggtcagcccatcagctgcagttgtgattgtgacactgggttggggcatcccgcccatggcagcagttgggaggccaggatgtctctgaagaccctacaggttgtgagtctgcacctgtgaagattgcagctccatggtctgcaggaagatttaatttcaaacagtttcttatgacattgtttttttcgtaaaggaattcatggaccctatttttcaaaaacaatctgtagtgtttctgcatccctcgagttactgtgatatcctggagaacaacttagtaactttttaagactgaacctgccacctgctgccagcgaagccattggctgctgcttcagacagagcctaagggggttttcctgggagggctgcaggcatgagtgagggagacacatggaggccacatgccctctacccatccatctccaatgggtcacagaagcttgccccagctggcccaggagaaactggcatctggaaggtcctgcagacctcagggagacccggcctgcttaggtccaccgatcttccaaggacccggtgcaagaacagaggtgagttgtagcgagcctgctaattttgtgtcatctgagctgttcatctgagccgttcatcctcctctcttctcttcccaactccttcctggaatcctcagtacggtcacccgcagagattccccatgagccaaacagaagaggaaaatgcatgtgtggagacccaccaagttccctctcctctaggaatattccagagaagcaggcaatcccccctgccacatacacaccctgtcactgctgcgctgaccctgcagagtcagtcctgatgcagacccatgaggatcctctgccagaaccatctgcatttgccatagaaccccagagcctattgttttggttgaaggatcggttccatggatccatttctgactgtctttattcttttatcggaattttggttttgtgatttcaaaatttgggctggaaggggggttggacaaaattattatatctgaaccatgggaaaaaaacactggcaaaaatgctacaaataactcacaaagaagctctcatgagtcaaaagggctccttcttcacagatctgctgagtggagttgaggaaaccaggcattgtgtgtgataaattctgttatccagagagactagaaacgcttcccccaaaatcaaatgagagacagaaccaggataaaatccaggtcccctggtcaacaatcattgcactttgtcactaaaaatacatttaccacatgagaaaccgggtctcagagagactcagaggcttcacctgtgttccgaggaatgtttccctgacaaggtagagatgacatcacaacggtggaggccttcttattataaaaacaatgcttctggccagaattaattatttattacatttatttagagtatctttgtctgccaaacgtgcaaacatttcccccagaaaactgaaggaatatagcgctacccgccgcacagttggcaaatagaagtgcattttaaaagccaaattaaccgctggtttttccatttcctctgcttttaaataccatgcttccaactctaaataggaaaataaatgtttgcagattaaaggttccattttattgcaaatattcatgaagattaaatgtcattttaatcacatgttagtttatttctctgggcatatcatatctgcatgggttcactcactgtagggaaatgagttttgcttgtgccagctggggtttatttaccattagttctcatccccgcattcgtgtgaagctccttgagtcagaaaatacatctcgcaaccaactaattggtgttcacggatggaaactttcaaacttgggcttcagagaggccaaggtaccgcggtagcaaaatcctttttcgcccatcaaagcaacagccaccctgtgggctggtggaaggctgaggccgctggctgttcactgtccggggaccaggcagagatggtggcgacacctgccctaaatccagcctggaacccttcccccagggaaaactgggcatgctgattctgtttccagggaaaagagacagtagatccaagcaagtgttgtcatccagtgtggcccgaggtggagcgtgtccctgggactgctgtcccctcccacctgtgttttagaacccgtggcatttgtccttgtgtttattttctttttttcttgccttcttgatgggctattcagtgtgagatcaattgtattcaataagaagaaaagacaggattgaaagaatagattttgcttttaggcaaaatctggtttgggattgttgagaattatgtttttttctgatatataataaatgccactggagaaatctcacaatacactctggtttcaatgggcaataattcaaggaggaagcacctccttttgagttttgagagcagagttcctgttctcactggtgagcttggcgtgcacatggggctgggctttgtctcggtgctgtgtagactgagggatgcctttttatttgccactgccggggctgtagcctcttaattcctccatcttcttcttttagaaaacgtaacagttgactcatgattcccgaggaaagtgacggcctcatcaagcacttattatttcaactgttcctctccttagaaatcacatagaaaatgtatctcggggtgtattttatcctggttcaacctcttcagaataaatgatgttttagttgtggtttcatccgtggcctttgtccacagaatgaagaacctgtgttctccaaggatggccgaaagtttttcttcatcagagccatcccccagggaggacgagggaaattctatcacatcacggtgtcctcgtcccaggtaagtcctgctagtttccggagctgaactagaaactggcctgctagaggccgtggggtgacagcctctagggctgggcacacttgcgttttcgaggaccccaaggaatctgaaggtggttcccgaaggcagggcagggcatggcgctggtgagtgcagaggttcccatcaggcctggtggaaccttgctctatctggtcacgtgcgagaatgtgaatgacgcttctgccaaggtcagcagagaccctggggtcccctgttcagtgtaaggccaaggatgttggaggactgtctgtgccgggggccctttccttctccctctgctgagggtctccttaacatactccccgctgaggcatggctccatgcactcaacatccctcaggggtccagcctcccatgctgccctacctccacccggagttggatgcaggtattattttattatgtgaccgctaccagccatcactcactggttctggggtctggcgagttcggaatggagcatccctgagtagggaatctcagagattaatatacgtgaatctaggatcaaaagtagacatctcggggtcaccatctcctgaagaggtcacctcagggagcctcacgcctgcaggacggggctgccatggtgttgactttgggggactctgccctgaggaagaagggaagcatgatcttggatctcctcagttttggaggcagtctaaagttatttgggatcagggtaaatgaatgaaatttgattagagaaaatgttaatcacaaatattctatggctatgacatagaaggctcatatttatgatgaggcctcaaaggcaatttcaaaagaaaatccaagaacatccgcactaagagcagctctgatggaatcagggtgggggctgcgggacccctgggatggaatcggggtgggggctgcgggactcctgggatggaaatggcgtctcttggaggttcaggtgcaattttttctcagtgcacttcatgacacgattgatagaatgtctgcaagctgttgcctttgctttttcctgcggtcttcattctaccatccaaattcttttgtttattattttacatcacttatatcaagattttaaaatgctggccaggtgcggtggctcacgcctgtaatcccagcactttgggaggccaaggcaggtggattacctgagatcaggagttcaagaccagtggccaacatggcgaaacaaaaattagctgggcatggtggcacctgcctgtagtcccagctacttgggagactgaagtaggagaattgcttgaacccgggaggcggaggctgcagtaagctgagatcgtgccactgcactccagcctgggtgacagagtgagacactgtctcaaaaaaaaaaaaaaaaaagatttataaatgcttcagtgttttcatttggctcccagtcttgtatttatccaagttgccatcatttgcccggagccctatcaaacattccagcaggaagcaggtctcctgcactgcccatgaggcaccacctcctgcaggttcccaggaacccctcggggggcccccagggccttccctttcaaaacctgcttcaaactccccagcctctcctacacgctgtctgcgcccccaggccctgctgccccccaacccccatgttcgagtctgcagcccacagagtgtgtgccttgggccctccacctagtttaatctccacctgctctgcgcccacctcccagggcatctgccttccagaacagctgcccatttcaaatccccactgaaacatcgctcccgcctagatggccctgtctctctcttctgttaccattggtcgttaccattgtctgttaccattcttcttagctcaaggggaacatagggaaagacaatgcgtgcaaaacttgtagtgtggcaatacaggtccaaactgtccttgtcagtggcagcagggagcgccctttctccctccgtttattcttctctctttttccctccacctcccggcatttgtctctttcctccctcactggtcccccttcagtaatggctccattaattagatttacaaatgaaaaaggcctataaagcattgattctcctcctgagatgcttccatcatggttggaggccaggtccaagtgattcgcgtcaccaaagaggacagggcactgttcccaccactgacattcgggggtcggggaggctgcgggcctggggttggttgggaagcctcaaggaggatgttgcctcccaggagaggagcaggcagaaggggcagagagcccttcccacagagagaatggcagcccctgtcacctggtgtccaaaacagttggaggatgaagagccatgctggggccgggacaccggtgtctgctcctgatgccatgtctgtgtgtttcagcccaacagcagcaacgacaacatccagtccatcacctccggggactgggacgtgaccaagatcctagcctacgatgagaaggggaataagatgtgagtgagaaccaggggcctgccccatcttactggccaatggggcacatttgttattttttgtcaattacacttatggagtacaggagcacaggaggcctcctctttcctcctcaggcagcatcactgactcctagtttcttcatgaaaatgtatagtagattcccgtcccaacagtccgacttccagagctgcggcgtcctgaggacgcaattaggcttgcagccagcccatgaagggaagcacgctagcggcagtagtaggggtagtactgatgttgattgagtttttactagtccaggctctaagccaagtgctttacagacattatctcattgaatacaacagttccatgaggtgagtttactgctttccccattttaaaaataagtaaatgaaaacaaaaataagtaatttgctccaggttattcagttggtagcgggtagatttggctcagatgaggggagcccagttcggaggactttaccaccatacaatttcacctccctgctcctggggtaaaagccaaggtttctgcattgggaggtcttaggtgaaaatgagtcaacaactatttattgggccaggctatatgtctgaacttgtcttaaatgtgctcagctccttgcccttcagaaggtgagtgatcttgtaaaagatttccacatccacattcaggtgtgtgtcacccccaaccacagtaccctctggccacgaagcagaggccagtgcagggggcacccggagccagtggaatctgcactggtgtccctcagcccttaggtgtctggccaccccctgctctggtcacaggtgtagctggacctgaacaggggagctactccctgcaggccatgggcggcagtccctgaggagtgtccatagaggtagtgccaggaatgtgaagtgcagacgtgccttggagcaaactaaccctgtgcaccttggtgatctttgcagctacttcctgagcacggaggacctgcctcggagacgacaactctacaggtaactcctgctccccctgcacacagggctctcccccttaggagggcatccaggctttgcagaattgcaccttttcagcagttcggaaagggcggcagcaaagacagaccccaccacagaggagtagctgtagagtctggagagaagtaatgaaacttgcagaggccaccaaaggggtagttttgagacttttgaagctttatttttctgctgttgttgacttgggttttccctgtcacccacttgcctctttggctaacggatggactttaacccgtctttccttttcacttctattcaatgtcacctcggaggaattctgccccccctgccccaccacagattttttgtagggagcagagtgtgatttggaaacaaacccgtgggtcagcacgaggaggccggccctgctgtccggcattgtagctcactggctttggggaactctgccctgaggaagacagggagcatgatctcgaagctcctcagtttggaagcagtctaaagttatttgggatcagggtaggtaaatgaaatttgattagaaaaaaaaggttaatcacaaatattctatagctataaagtagaaggctaatatttatgatgaggccctaaaggcaatttcccttctcaacagcccaactgtgcgactttggacaagtttccaaatctcaaagagggcagggaccctgtgttctgaaccctggagggggactggttttttttctagggcgtgtccctcttctacatttagtcctgtcatctgcccagtcactgttctcactaaaggaggctttgggttgtgaagtgagattagccctgggcactttctaccagggccacagaggtgaggagggggtgtctgctgcctcccccgtgcctctgcatgggatggctgcagccagttacacctaaaggcacctgggccgctgaagaggatgttgttcaggggagacctgaggcttgaggccagtggcgcattgtctaaatggtgccaatgcctgttgcccccgccccactgctgggacattgggaagcccccctggtgaacgcagcctcccttcccagccatcggccgctatgcggacaggatgaggtcagcatgagggagccagtccgtgtagatgttccatcgtcaccatgtgtctactaggaaaattgaaatacacatgtcaccaattaataaacatgagaggctgcctgtggcccctgtcctctaaattacagaatgagaaggttgtcttctctctcccgtgaaatatctttgctcctggaacaacagacttcatattgaaacctatggttagaggggaccctcctgcggcaaaatgttcagataagaacttcttccaggtagatccggtatcttaggatctttccattttagggagcacattttaggccttcttgacttgaaatgacacttgaccacagtggtcccaggtaacatcttcaagccagttcccacttgtgtagctccgttgagtgggaagcgcgagctctcgaggtttcactctgtcaggggatgtggcttttggaagctgccagagttcaattccactggtgctgctggagcccctgcctgctcacatgccagcgtttggaacccagataatttgaagatatgtcactctgtctactgttctcagattgctagccatccactcagagggacaggacacgtgcagatagagtgctagatcatataacactgacagctccatgctcctcacaccaggccacctgcagagcctggagaaggcagcataggtgactgccttccagccctcccacaagcaaggatgctgaaagctcttgagagtgggagggacccaccagcaaaggaaggtggaaatggagctgggtggtctcaggggctccagcagggagacagagggagaggcccggggggtctgtagcagggctccgcagatcaccctcatggggagagcccaccagcttgcggcacccagcgtggagggcagctcctctccgcccacattcacacctgcgtcctttgctcttccagtgccaacacggtgggcaacttcaacaggcagtgcctctcctgtgacctggttgagaactgcacctacttcagcgcttccttcagccatagcatggacttcttcctgctcaagtgcgaaggtcagctcctgccaccccgtcagggcaaagagccctggcaggcacatttgcagggagggggtgggcacacttgcagggagggggcagcggctgtggtgggagcacagcgtattccagaacaggtgaggatcccgcctacctgataacattgcttatggtgcaagatgactggacccccacagagcctggtgcagtggggctactttacgtttcatacaggtgtacagcttatcagagtgttctgtgcacactgtgccagtaatctctcagtttgtctcccattgtccacaaaaaataatagtcccatgagctaggaagggcaaatatcctacacagtgatgagccaaagccatcaatccatcaataaagataggaaaacaatttcaaagattaacttttcaatcatatttaaggatgattgaatatcaccaggcacggtggctcacgcttgtaatcccagcgctttgggaggccaaggtgggcagattcacctgaggtcaggagttcgagacctgcctggctaacatggcgaaatcccgtctctactaaaaatacaaaaattagccgggcctggtggtgaatgcctgtaatctcagctactagggaggctgaggcagaagaattgcttgaacccaggaggtggaggttgcagtgagctgagatcgcaccactacactccagcctgggcaacagagtgagactccatctcaaatgactagataagaaaaaaaggattgaggttatgttaaagaagtctcagaaaaatatttccctatgtcccaattcattgataatttatcccaaactgcaagagtttgatcacaccaaccagcatacacaaaagagtaggccatgttgcatatgggatacaaaggatatttttgctgcttgtctgtatcttggaaagatatgatatgaacccatggaaaggtaagtcatcctaaatatggtcgtaacaaaatatgatctcctgcgatgacctcaaagaatgaaaatatgccacaggcagagactaagatcaggagcaatttgctcctctgtcagagtttcaatcccctaagccataggtggagaatgaataacttttatcagagcaatgtctttgctagcctttgctagctactagagagctcatgacttcatgacttcgttctctttttatcagtgtcatctaaaatcttgaaaatccgcagaacagggacactcagcctcttgctcaacacaagctcagcccctgacattcttctaagacagcaaggagaccacggagggatgaggggggtgcgactgaaatataacattagtgccccagtccccgcaacgttaatggtaccaaattcctctttcctgtgtgtcccaagaaggaggccaccaagtatctgaaatcatagagtgctgtaggggaaagaacctaagatctaactgacccacttcatgtatcagatggcaaaccctaagccagaagttgagtggattccctgactcccaatgagccagtgacacagagagggccagcatcaaggtctcccagttcctagcccagtgacatctgtctcctagggcgggatcttcttgaaataagaacttgggaaattacagggattgacggggcatagggattgggaaaatgtggcaagcagacccactaggagccagagagtcttttgaggagctacataatcagaatccacaatcctgtctcagaagcaggaggcagcttcagcacacaggaggtcatgatcaaacacagaagtgaaaaattgaagtagatttcaagaagagtgccccaagcaacaaaggttgaatgagaaaggtgacagagcctccatcgtggagatcctgagtcagggacagaggtcatttgccagaggggcttggtctggcctaggcaggaggcagagcctttgggatctgaggtctgcactggtcaagacagcaactttatggatttgtatttcccaaattcttactataaccagcaagaagggtctggcttctcaccgttcatggaaagaagtcaaaataataatgagttgtgatatgaaggagtgatatttctttattacctatgccaccaaggggaagagcagaaagcaattccactcttcaatttgtggagcaaatacagggtttctttttttaaaaaaaaaaaagaagaagaagggtttggaatggggaagagcttggggggttaggaggtgccaaggagtgtgactggctgtggtggcccctctttaattattgtcccatttgatgaaggagctggcaccattgtggatcccaccaggttatcagttaatcacagtcagccttgtagtcactcttcagccatgagcgggtttcatccttgaagtaatcttttgttaaagaaagaattctggaggtatctgggtcctatcaggagctgactcctggaggttttaaggaaatacatgaccagataagaaagcatggtgtgtgctccacaagcatccgggttaataaatgtgcataaggcatgagagcatagaatgggaaaagaaagggagtggaggcgacagcacattctgaggctgtgtttcaagatgaaaggtaacacatacgcagcttgtctcaaagttgtatcttgagacagggagcagacagaagaggagaggagaaagaaaaaaagtttaaatcgtggtttgaggctgagctgctcggtcatattcctaacacatactaacatctgctccacatggtgaccctcccagaatccagaatccaacagcttatttgttgttgttgttgttgtttgagatggagtcttgctctgccgcccaggctggagtgcactagtgccatctcagctcactgcaacctctgcctcccggtttcaagcgattctcctgcctcagcctcccaagtagctgggattacatggatacataatttttgtatttttagtaaagacagggttttgccatgttggccaggctggtctcacactcctggtctcaaatgttccacctgccttggcctcccaaagtgctgggattacagacaaaagccacctcacctggcccttacttaacaaacactttcgctgcttccctttggaggtcacagctccctgctaagttcaagctcaagttcagtctggatgcctcattctgacaactggaagccttttatggttcagtttccataagctgcagccctgggttgaaatccaaaaggctctcccaggagatccatggccatggatttaggcagggaagttccagttcccacatggtggatgtaaacatggagcccgtggtagatagaaacacagcctggtgttgggaggctgcttggacagagtgttaaagtttagagagcactatagggtggctcctgtgcggatttctagtctgccactggccttctgtcccaagggagattcgtatttctttttatgtttatgtatttgcaaggcttgtgttgtggtctgcaaatagttattgtgaagagatgactccatagttgatacctgggaggaaaacagaagcaaagaacaagtacagcaacacaaggtcagacacacgactgacccagcccccaggtacagccacactgggtcacacacacatgactgacccggaccccaggtacagccacactgggtcacacacacgactgacccagtccccaagtacagccacactgggtcacacacacacaactaacctggcccattgggcacctccacaatctcaccttcagaaaggatgggatgctcctcctgccaatgcctggatccctataataatcaaacagattcctagaatttgaagataggaatagatctcagagcatctaatccagtctccaccctgcctttcttttgttgattcagaaactgaactcttagtcattatgaaattatcacgctagggtttcctgaatcatttaagatctatttaaatatttagcctgttgcctcatcttaaggtagacataaactagccctcttctctacaaaattgctctttaaagtgtttacataataagctattttctggctaaagtaacttttgaatgcccaaattaaactctccccatggaggtaaccaaaatcccacttataaaaagagattttctgaaaaggtttaaatttacaaagacaacaaagtacatggggagacaggagcagccaactgtttgaacctggaagcagttaccagtgataactgacctggcagaccctgaagctgagcctcgtcctgccatggggaaagctgagcaggcattggcgatgattgcctaagggatgagaagatcaattgctatgaaatcttaaaggagaaagtgattatacccatttggattgcttggggcattttgctggaggagaagactcaaggaaggtgtcaatgatgaggtggcatttaaaacaaatgagtaggtaggatttggaatgggaaaaagcagtccaagtggaaggtacaccctgagaaaaagcacaagaaatgttgtaagattatgcaatggaatcttttgcagcatgtgaatcaggatcaagtgaatacaagcaacctgatttaataaacaaagataatttaaaataattttatttttctccacgtttctcagtagatattaaaatggacccagatgtgtagtctagagcaacgtttagtcaatgctcatgtcctgtcctgtttccttcacaccccaagttattctgagagattcttggaaacctgtgacaaaaataacgtctccactcctagcattagagactcttgttttcttctccttccctcctcctgcagcattttgttatataaattaacttagtcttctagttgcaaccagaaccaaaaaaatcctccttttttaggttgaggataaatgtactggcaatgagaggcttctctatggtaaaatctgtaaacatgcccacattcaaagctgttcatcccgtcacacagggagggaagtgtaagtagttcaggttgtctgggcataggaagggatgatcatcaaaggatttaacaactaggacaaggtggataccaaccagccaaaagacatgtccctgagagcagatataggctatcaaaccacattaggacataagggctgggtataaaatcatgaaattataactgtttcatatagacttcaacattcttcctgcctttctgtgggccttccattaggacagtttttggtaagtttagctgatattgacctatcctgtaacttatattcagtattataacttatattcagcaatataactttattgtcttagtccatttgggctgctatagtgaagttctatagactgtgtggcttataaacaacagaaaattatttctcacagttctggaagctggaaatccaagaccagggtaccagcatggttgattctggtaagggccctcttctgggtcacagatgaccagtttctccttgtatcctcatgtggtgggaaagagggtgacagagctctctggggcctcattataagtgcactaatgccattcccaagggttccactcttgggacctaatcacctctcaaaggccccacctcttaataccatcacgttggaggttaggacttaatgtataaatgtgggggggacataaacactcagtccattgtaatcatagctgattgtagctcatcagttgtttgcaaacagtatttctatttcgttagtcctttggcatactgatcttctcctaatgttcagtttttcttccacagtgtattttgtccaacatcattatagagttccatctagcagtatcaatgtgtgctttctctaatttttcattaacatttcttcagcggcttctcaatatttgacatttgtatgcttatatgtttatgttttatgtttataattcttaattccttaaaattttttattgtacatacaaacctaaaaattatttttaggttaataataattactattaacttaaataataattattttaggttaattcctcaattttttttttttgagacagagtctcgctctgttgcccaggctagagtacagtggcatgatcttggctcattgcaagctctgcctcctggtttcacgccattctcctgcctcagcctcctgagtagctgggactacaggtgcccgccacaatgcccagctaatttttttttgtatttttattagagacgggttttcactgtgttagccaggatggtctcaatctcctgaccttgtgatctgcccacctcggcctcccaaagtgctgggattacaggcatgagccaccgtgcctggccaattccttaatttttgattgtacatacaaacccataaattatttttctactttgcacagttacattaaaaatatattcgaatacaatatataaatagaggttcagaaatgcttatagccactatatccactcactacctcactggatcccatctctgagtgtcaatatttatatctaaaggacatgggtttcagatgacccctggatacttgtgcgagggatcagctgtaagccaaactcagtggaacattgtggaaactcacctatctatgtaatacagagagtttctgtccacctctctattgtctggaagtgaagccagctatattctaaatattgtattatgatgtaaccttttatgatgattttccagaatataccaagcagcttttggcatacatacttaattggtcttctcaatgaccctgtgaaatgggtagtaaaagaaataatcttctatttgttaagttctttacaatttgaaaagcacatttcttttttttttttttttttttgagatggagttttgttcttgtcacccaggctggagtgcaatgacacaatctgggctcactgcaacctccgcctcccaggttcaagcaattctcctgcctcagcctcttgagtagctgggattacaagcgccaaccaccacacccagctaatttttgtatttttagtagagacggggttttgcaatgttggttaggtgggtcttgagctcttgacctcaggtgatccacctgcctcggcctcccaaagtactgggattacaggctttgagccacggtgcctggcctgaaaagtacatttctaattacattataacagttgatgactatgttcccatttctgattccttgaaatttatattctagcgtaaatatatctacttagaattccctaaactcaatatcatttttcacatttccatgcttttgtctttgactacctgataaacccctatacattctccaagactttcagggcagggttgattttcatccccttacaggagggatgaatgagaagtcagagaacatgaaagtggctgtgtattcacccgcagaccaacgcctgtgacaggaactcagtcttcagctgtcttagatgactggggatgcccaggacaggggaaggctgggtggtctcaccttctagtcctggataaacccaattccatctttaaagaaaaaaagcactcacctcctggactcatcttctaggacagctaacaaattaccgcaatctggatggtttaaaccaacagaaatttagtctctcacagttctggaggccggaaatccaaaatcaagctgttagccagtgtggtttctcttggaggctgtgagggagaatctgttccacgtttctctcgagcttctggtggttgccagcagtccttggcattttttgacttaccaatgtattgctttcatctttgccttcatcttcatgtggtcttccccctctgtctctgcatccaaatttcccacttcttatgtggatgccaatcattggatgaggacccacctaatccagcgtagcttcatcttaacttgactacacctgcaaagacctcgtttccaaataaggtcacattcacaggaaccgagggtcaggacttcagtgtaacttttggggggacaccattaattaaacccacaacacttcccttctaaggactgcattgccttcttatataagaaagaaagagtgctcagcttgttcttctcaggaacacaaaattaagggcagccacactagactgtgccagagacagttcttaatggtttcactgcattctggaagcagcaagggggtcactgaaggaagtaatgtgatactaccatatctttggatagcaactctagcatattagaggaagaagagcagttccagtatagattctctctaggaatacttcttccctgtcataatgcaaaattcacagtcaagtggcatacagccataacaagttctgtagggttttctcctacccatctaaattcaaccgccagagccactgaacaacagaatcgaagtgcccaatttacataatttgtgtttcacagtcctcgcctctgttgagagaactggatttttctcttcaaaatgaatctcaagagtatgatttattttccttcaagtttttgaaaacgactcaatcaatcctgtttctaagaaatgtccaaatgccaccaggaaagtgagttccgtgtatgaattggccatttggtgcttcctactgaaacattttttgtatgtttaaaaatagctaaataaacttccttctcctgaagccgaggatggaattattgcagtcacttgctgctctgagtgggaacgggacagtctgtgttcatgaatcccttacagctctgggctctcacccccgcccctttcagtgttgagccatgattagggagctactttccagactttaagaagtttggtcttagacttagcagattggtttatcaagacaggcttctccttctccaagttgagtggaaccaaagtattattacctgagcctaaaatacagtgactcaaatctgataactattcttcttactattaaatattccccaagatcttctgtcatcaccatcattgccatcattatcaaaatcacaggagattgaaatggcagtaagggaggtctatggagtatggaaccgtagagctgggttcaaacctggactctgccacctacagcttcgcgaccttgggcatcttggttaaccttgcttaatcctccacaccctcatcctgaaaatcggaggaataacagtatggcagtccccccttatccacagttctagtttttgaggtttcagttacctagagtcaactatgctctgaaaatattataaacaataagatattttgagagagagagacaccacattcataataacttttattacagtatattgttataatagtttgatttcattattagttattgttctcttactatgcctaatttataaatgaaactttataattaggtatgtaggcacagaaaaaacattatatatatggggttcaatactatcattggtttcagacatccactggggtctgggaacatgtccctggtggatatggggcaccactgtacctgtcctgtgaggctgttttgaagattaacctagatagtgcatgtagagtacttaccatggcatctgatacatagtgagtgtttaataataagtgttaactatcataattgttttcatcattgtcatcaccttagtaatcaattgagtttcttacacatccacttgctacccactcagtatccaaaagttggggccaaggctgggggtggctgacgtgcatgaagtcaatgaagcagcatcccttcccacatgttagtgggcactccagcacctcagcaggcttaggttggaacccctggatcttgcacttacactagcaaattccagaagcggccatggatgccagagccacaaaacattaaatcaactgtcaggcatggcaatgagtacctggtggcttccagagtgcatgtgtccaccgtggtcctcacagttggttcctggcagaagttaagaagtaaatttccagctttcttagcacctgcccgttccttctgctgtgacctttcccctccatgccttcaggtgcccggagctcccagatgcccctcctacatcctctcgctgcaaaacataattaaccaggggaaatgtccacgaaggtgccattaaggtgtcctgcaaatatgtatactaaggtgcttgttattcttccccaggttttagtcagagcagtgagtaaggcagggatgaaaaacaggaatcagccaaccagctccacttgttgggaaggcactggctgcagtgctatggatgagaagggttctgaggccaagtgcaggttcagcaggaaagaacatcatgagtgattaacggatgatgtcatgaaagtcgtaagcgattgatggatgacgtcacaaaagtcatgatgtcattaacatcatgagtgatttatgatgtcatgaacattatgagtgattgatatatgatgtcatgaacatcatgagtgagtgattaatatgagcaacttcaagagtaattgatgaatgatgtcatgagggtcatgagtgatgatataatgaaacatgagtgagtgactaatgtcaggcacatcatgagtgatcgatgttacgaatatcatgagtgatcgattgatgatgtcatgaacatcatgagtgaatgattaatgtcataaatgtcacaagtaactgatgtcatgaatgtcctgagtgattaatgacatgagcatcatgagtgattgatgccatggatgtcatgagtgattgaagggtgatgtcatgaatgtcctcagtgattgatggatgatgtcatgaatgtcctgagtgattaatgacatgagcatcatgagtgattgatgggtgatgtcatgaatgtcctgagtgattgatggatgatgtcatgaatgtcctgattgattagtgatgtgtgtcacccacagtcatgggggagcaggtggcagccacatgccatgcatctatgatgtttggtgtaatcccctgaaatgaatgaacacctccacatggtgagacttcagattccatattatccaagatgacatacatttggaagtttgagatttatcctaaaactcaccttgtactgcagaatgaggtgaaggggcttatttttttaagggcctagactcctgaagcattatggccagccaaaatagaagtgacagcatgtcacttcagagaagagaaaagggcatgcatgaagagacgcagattgagactcggttacctgaagggatggaaatggctgtcatggaaactctcctgagggaggctgttgcccagggtttctaactgaagggcacctcttctgtcatacatcttttgaatgagggagaagaaatctccagatccttccagagtggctcaggggtgatactgattcacaccccttcagagtgctggatcaacagtgtaagcaggcatgccctttgcatgatcccaacataggaattaaatattctactgctggtcaaattatttgctaataactcatgcctaaccgtaaatgagtagtcccagagctagaaaaataatacatagtttgcgtcttcattgataaaactgtcttattagcctcaaacatgtagggtgctattgactcccaacagcaaatttgaaaacaaatggtttggttctacaaactagttaatcctctagacatctcttatatcaaaatttccaagaaatttacctcagctgccctttttaattttgaatttatccaagtgaatgtttagaaccggtttgaagctccttggagcattgctggtgtgtttgtaagaacatctgttcagtctctcaaacatttggagccattccctttgaggctgcatgaaccaagaacaaggaaagggattctcaaggcaggttatattgttaatgtaagtgacatgaatactctggaacatgtcacactcttcagtaaatgctaccagacaccacgcaaaccactcatattcctcctcagtaacaaccaaacaaacatcttccatggaaaagaagcttctcactttgccactcaacacctttcccattcctgggcagtggcaggtatgctgaacctggtacgagtgtgcctttctacatcagaggccatgtcctgcagtctttcatctgaaatgtccattaaaaataaataatgggctgggcatggtgactcacgcctgtaatgccagcattttggaaggccgaggcagacaaatcacctgaggtcaggaattcaagaccagcctggccaatatggtgaaaccctgtctctactaaaaatacaaaaattagctggacgtgatggcacgtgcctttaattccagctactcaggaggctgagacaggagaatcacttgaacccgggaagcagaggttgcagtgagctgagatcatgccattgccctccagcgtgggcaacaagagtgaaactctgtctcaataaataaataaattaattaattaattaattcaactcaataaataatgactctagaatgtgtccattccttttatccttgttgccccagctctgggtaataaaagccattttgttactggtcagttttcctgtgagatttcccactagccagttcaccttgcttctgcctgaatatgaccagatggtatttcctaaagaatatctctcttcaaaatggcttccagagcacatacatttctcttttttctaagtaaaatgatagaagaaataaaacaaaaacaaaaacaaaaacaatgccactgggccactaggaaggggccccaatggactaaaatgttgaagaatttttgtaaagtaaacataaatggttcactgttaaagtgaaagccagacacaagggaatgtaacataattggcaaaagacatgattataaaatgaagaccaaaaagaagtttgtttttttagaattctgaattgtggagcacctgtcagagtagatgctgccgcctcccatttttgcccctaagacaaaaggagacttggccagggagacttccagagtggacggtggggctggaaggggagctgtgccgcaggtggccacaaagccaaggccccaagcactgcaagaggccccctcatcccttcatcactgccctgtctccacctggcatcagaatccgcattcacggagggagtggctctatggctgctgaagccatgtgtccacagcctgggccccacctggacgagagtatagccaacagggcaccactgcagcacacgggacacgcgaaagggaggcctcagaccgagcgcctgggaaggaaatccctggagaagcattttaaagatcttgtccatctgctgcagccagaccgactgtaaatatcctccgagagattccagaaggcgtcacctttaccacacagagcggtaaagagtgggctgctgtgaaaatgaaggaagctgactgctcaagacttacaatatttacaaaacaaatttttgtaattcagaagaagaactgaataggtaaagtagtcaaataccccagttgcccccaaaagcctggatcacgctgacgtaaatgaatacggcttcttaattatttctagtgcttcttcccttcacttcctgaagtgttcttgtttggtcaaaattatgaacagaacaacaccagaaagtgccctagaaaatacaaccaaaaggcttcccagaggacccaagaactggacaaagatgaacattcaaacacttttgagagctatgaaaaatagatccaacgaatgtaatctcttggtagaggctttagaaggagagattggggagaaggaagggggaagaaataaatcaagatatgatggaaaaaaactttccccatgcttttgagtcgttagggaaaagaaacctaatgagtgtaattctaagaattttggagaagatctaacgatacatacctcctaataaaacttgacaattcaagtttagaaattatataagattacaggcagggctcagtggctcatacctgttaactgaaccaactaattaaatatagactggccccatgaaacgtgttcttcatgtttactgaaagcatattcttaaggccggtgttggggatgcccttctggctactgtacttcaagatgttctctgcagagggtcatttggaataaattttcctctggtctcaacaccaggaatggttgagcttctcataacctatctaatgggctgtgaattgtgtttccctaaactgtgttggctgctagagagcttagcatgaaatgtgtggcatatgtgggtaggtctttatagcacacatttttaatctttttcctgatgtcttttcttttttctttttacattgttctgatagcctcacttactcattttaagcttattttatttttatctgtgcattcatatcatccttatctgccttcagtcctttttgccactagatccaacatggatagacagataatagatgagagggaaatgactgaccgattgattggcaggtaggaaaattaaagtactcttagcctagcattcaaggctgcatacaatctggccacatcctacttatccagcctcgtaatgacactactcctctatcagagctttcaaacacttttagaggcacaatcagttttcaaatgaaatgttaagtgaatatatatatatatattttttttctgtatatatatatatatatacacatatatatatatatacacatatatatatacacacacatatatatatacacacacacatatatatatacagaaaaaacatggtgttttgttagtattaaaatgtttcctcaagtcaaagtatagcatttgcttttcagttcaatcaaaggaaacagtaagaccattttggtgactacaaaatgtaaactactaattaagagatacaggtccaagttacagcctcttgttaatcaccgtcatcctccaggaaattcacagtaagcctttgcagacccacagcggtgcttccggttaaaagccagtgtggaatacatgtctcaagcttccctgatgttatttctgtacctgtcaaactagcaacttatttaaatatctgatacaacctccgagattcaacctcataaactttctctggtcacatcctcgctccctccttccctggggctctgagggcattttttgcctttacgccgttgcatcttgtccatccctttacaaatgctgagctcccagaggcaagactgtttcactgatatctgtgcagcagccttatagtagactgtcttcatccatcctggcagctgtaacaaaataccataaactgggcagtgtctaaacagcagaaatttatttctcacagttccagagggtgggaagcccaaggccaaggcaactcggtgtctggtgagggcgtgctatctcgctgcgtcctcacatggtggaaggggcaagggagctctcttgggccttttttattaaaaccctaatcctattcagaggcctccaccctcgtgatttaatcataccctaaggcccgaccccctaacactgtcaccttgtgggtaaggatttcaacagaggaatctaggagggacacaaacattcaaaccatagcccagactatgtgtagctgacgctgtgccagattgcgatattcactttgtgggttcaggggacaagaagacccagtgaaagcttgtagggaccttagggaccaaagccagtgacagtgtcagccccccgcccccaacgacttcatccacacctctgctcacagatgcctccctggcaccctctcaaaggccccaccctaattgctctctagccctcatcctgctcctccatcctatttcctgctcttcatcctgttttctctcttgcacgtttcactcctgccattgatttttctgtgtatgttttcagatgcccatcttctccactggcgtgtagttcagtgagtataggaactttgtttgacccaccactttgatcctgacatctagtgcaagagctgtggcatagtgtcctccataaattagcatttttaaatggatgaataaaagctgcactaccatactatactttggggccaatgcagacctaggttagggtcataatcttactctagaacttcctggaaaataagttaatacacatgccatttttaggttacaatgaaagctgcttctcatattgtgagtagccaaaatattctttaagacattattttttttgccctcgtttataaaagcctgctcacaagacctggaactgtgaacactgatttaattttttaaacagaaatgttgtaaacaatgaaagagaatcaaaaacaattaaaataatgcaatatgcagtttgacccaggagtttgatgctgtggtgaactatgatggcaccactgtactccagcctgggtgacagagcaagatcctaactgtaaaataataataaccataatgcaatatgcaattttacaccctatacttaatgcacagtaaatgggtctgaatgaattttcaaagtgaatacatagaccttattggcaactttatatgtgtcttctctattacttcagagggaagtactggtgcctgcggataaagttttagggagacagatttcaacttaacataaagaaaaagtcactaaagtcctaaccatcattgtatggatctcatcgtgtgtaatatatggacatacggtgaaggtggacatgccaaactctcgtcccaggagttctccaggcagaaactagaggaccagtgataggcacatttgtgtaggatccctttttggattattttggactcgatggactaaggtccttgccagtttaagagtctgtgattgttcttctctgatactgactcaatagagcaacttcagggcccattgcagcacccaggcagatccggcaccttctccaaagatccttctctctgctccatgcagtggtgctgatggtaataataaaaaaccgaatgcatggagagatactgaagtgcatcctgaataatcatcaaaattcattgcatgtatgaagtcaaaatttctatttgcaaactttgttgaattacccattttgaaaagttgatctttgtcagtccctcaagacaaagtcaattccattcttctccttagtggctattggtgaaaagtctgtttcttagttgtagatcaggaaacagtgctgcttgactagaggattcctcgccttacacaaagactgctgacacattttggtcaacagtaaaatacctattcatctcttccacccatatttcaaaagtagataacttattccttaaggaatgtttttgttgttgttgttgttgttttgtttgtttgtttgtttgtttgttttgagacagagtttcacttttgttgcctaggctggagtgcagtggcgagacctcggctcactgcaacctctgcctcccgggttcaagcgattctcctgcctcagcctcccaagtagctgggattacaggcatgtgccaccacacccagctaattttgtatttttagtagagacagggtttcaccgtgttggccaggctggtctcaaactcctgacctcaggtgatccacctgcctcagcctcccagagtgctgggattacaggtgggagccaccgtgcccatccaggaatgttatcttaatgcttagtaaaatgaattagaagaggtgggaagtatctactagctcctaacaaaagtttttactttagctatgaagacataaaaagaatcagtcccaaacttaattattgatgctaatgaggaggaaaaagatgagagaaaatcagctgcttccctggctgtgcatttctgcttcagcaattccttgttgtttaagagaaaggtggcaaacgcaggtgcccactgcagccagaaaggaatggaaatgagtgaacccctctttgtgtcatataacggaggccactggagagaacccccggtctctgacaggaaccgttgtgactcagctctggtcagtcattgccattcagaaattgttagattgccagttcttccagtatttcagcagaagtactaaatccatatttccatataaaaatatgatttttaaatgttgacaacccattacaatttgaaaaatatttcttttggcgaaatgaaacacctgcaggccacatctggtccgcaggtgaccagtgagtggtgttcacttgaatcaatataccagatggccaaagaggacttcttcctgtttctcagccttgcttacaagctactcacttggtcattaagaaatcaccaaagcttatgtagccagagggagccataacagaagtggatgtgcttaagtgtcaaggatccaacctggacactcagaaatccacaatactttttaaactgctctgtatgtaagactattttaaatctacctgtactgaattctgagctatgcaacagagttgagtaagacagcgttcatagtaatacatttctcccacttcagcacgcataaattgtcttccaagaaaagggatatttgtcacttattctaccagctgtcagtcagtcttcccttgatgttctgggaagctctttggcacctcagtgccttcgtcaccgacgtgagcatctgtccatgtgaggaaaagagaatgctgccacgacaggggttgtggtgactgttgaatctgcttttgctgcctcagtgttgaggaagccagggcccaggacttgcgcatggctagttaagagtggggtcaggactgcttcccgtgccccaactgccacactgctgtttctccaatgtcattcttctcattcatattctggttaattcagtagctggtcactgaggctttctgtgcttggcacacagcacgtggagaaggaacaggaaacaaacctgcaacattccctaagggaaaggtagaaaacaaagatcagggtcacacatttattctcacaaggcctgttggtttcatgagcaccagttttatagcttctcaaaccagggctagctcacatctaggtgagaaggtagcagatggtggttccagccactcatcccaccacacagaaacttatatcctagtgagtaactgcagaggaatcagtccagaagggaattacttcaccctacgtttcacaaacgcaaacccatgatcattacaagaatgggagctgcaactaatcataaggattgtgagcagttccaatcctgcacattccgagtttggcacagtgtatgagtttaataaatatttgaagccttcaaataggaacaaagagttttatggacacaaaatatgtcttaagtaactgttgagaaaagaaatgttggcttagctttagataaagtctctgtcttcctataccactctttatcttctagacattaaattgggtgtatattcttggtcaatatcccatattaaaaatgtactccctgaaaatattagcatgggtgacattttcctttgtaatcctgattccttggccagtttccttgttatcttcccaactgtctcctagctgaattgttcagtggttattattttacggactcatggagattcacaaggaggaagatgtccatttctccaccaacacccaaaggcttcttgagaacctcccagtgatgaaaatcgagagggtttctatgtgctagagctacaaatcaaacatggaacaacaaccttctcctcggcactgttgtccaacagcaacgacaaagcctaaatagggcagagaagggagagattcgaaaaatgaattagaaaaatctccttacaaagtgctttcttcaggaaatgtgggaccaaagaggcctgcagctttttctcttaatggagataaagtaggatcatccatgtgcttaaaatagtcacatgcagagaaaaatgagcagagacgtctggctaaatgttacatctgctttcactttcattaattttcttgcccagaagaaggtattagttaatgttagacagctgtcgaatgatacaccactttaaacacatttttaaagccactatttcatagtttgtagctgtaagtccatcagagtgagacaacatgaacatgaatatggagaacctagaaacacaacatagcatctatcatagtagacatcatctcctagcacatagtttaagctacgttgacaagaagtgtctgaagtttttattacttgcttctacttagaatggtaatataaactatttttaaatcagatgttacgggcatatgagatacataatctacactgaaatccaccccctcccagacacacacacacacacacacacacacttgaagacacccactggattttgaacatctcaatcagctcttccccattctcatcctctttcttatctgtttcttttccctcttcctcctccccttttcctcccttccccttcccttcccttctttattcttctgaccaattcagtctcaaagcctttagctgggtgaagacaggtgggcatctgcacagagaagtagccccgcatgggctgcctgagctcaagccaggaggtggaggcatctgcccgcctgggagcacctgggctgtggagtcagccctgggcaggaagagagggcgtctgcgcagaggggcagcctgtcgtgggaaatcagagcctaagagtaagggatgcgtctcttggaaaggatggcccactgggggtgtttaagcccaagcagagtgaggagggggtgtctcccagaaaggacggctggcaggggggtggtgtcgcagcccaagcagagtgaggagggggtgtctcccagaaaggacggctggcggggggggggtggtgtcggagcccaagtggagtgaggagggggtgtctcccagaaaggatgtcctgtgggggggtgtcagatcccaagcggagtgaggagaaggtgtctgcaaggagaggtagcagcgatggtgatgaaaatgtcttagactcaggagctagatcaagtaagaacagtaaagaagatgaaaacccagtttctccctgttggggatggaagtcacacatatggggaggtggaaactggaggcacacctgcgtggtgctggactggaactggggggagtggagtgagtccctgtctttctaaacgcagcgctgaactttcagctgaatcttcctgggactatttgcagaactcgaatggggtgtgaagattagcctgtaggagtgcgcctgtgtgaatttcctgaatgtaacggtaatgctgtggttctggaggagaacgccttattcgtgggagatacacagccccaagagcatttggggaagatggggcatcagctcagggattccttctcaaatgcttcagggggcaaagtcctttgccctgtacttgcagctttccttaagtttgaagttgctgtaaaatcttttttttttaattagataaaattttacaaaaatgaataaactgtgtgcctggcaaaggaattgagcgtgaaggtcactagcttcaggttggaaagtgctcttccctgtcaccaagcgtgcagccaccggcaaatgacaaagtcttgttctcaaaaacttaaaaagttttctaaagaaatagctgctaaagaaaatgagaagccagatagaaaaggcattgcctagtttattcttctccatttgagacattttcatcttctctaatatattccagcgggctacattaaacacctaagcagatagaatgtgtacatgttctagtaatcggtatatttatttcatgaaggtcattatgctagagtatgatcattatagttcaggcacaaaatctaaccatgtttcccctgggctctgacccatgcagatgtcagtatgcctccacaaggaccatcttccaggtaaacaggttacacttagctcagctttaagatggccataaatcttaaaatcgtggcatactgacttttgtttcagagtcaactctcagtagcctacacacctcagaatttgttttttagtttttcagccctactttcaattatttacagtgccctgaacatcaaatacagtctcggtctcgtacctttgtaagtcatgctatcatcaataatgcagataattgtattttgaaatgcctaattataattcacatttatatttatattattcaaacacccaatgcatttgccacatgctagacaataagaaaaacagaccaagaggctgagcgcagtggctcatgcctgtaatcccaacactctgggaggccgaggcaggtggatcgcttgagctcaagagtttgagaccagcctgggcaacatggcaaaaccatgtctctacaaaaaatacaaaaattagctggccatggtgtcatgcacccatagtcccagctgcttgagaggctgaggcagaaggattgcttgaacctgggaggtcgaggctgcagtgagctgtgattgtgccactgcaagccagcctaggcaacacagtgagaccctataagaaagaaaaaggaaaggagagaagagggggagaggaggagaggaggagaggaggagaggggaggggaatggtggggaggggagggaggagggagggaagaaggacagaaggagggaaggaaggaaggaaggaaaatggagagagggaggaagggaaaaagagaagaaaaacagaccaagatattagcaggaaagggactgaatttccaagcaaattgggagtcagtgcaagagtaatatcggctcaatggccaacaacaattagatggttttcagcagatgggggctagctggcatcatacgcaagagcatcagtctcagccagatgggaactttgaggttcctgtgattagcttggtaattctaagaggaactgcagaccacttgccataggtaagatgcttcctccatcctgctcaaagccctcccacccttcaccaccaccaaacaccatctctgctcctcatgtggaatctagggccctccacaattgaaagtcagccttccagaagtgcctcctgtgatgctggtgcacagacccctgggccctttctgtttgctgttcaagtctcgagactgcctgtgccctcccgcagctgtgctcttgccgctgccgttctcaccacccgatagctccttcccagactttcaggccgtcaaaatcctcaccttcctttaaaattctctggttcacatcagctttgtaagtatatcctgagcaagtattaagtgatcttgatgatttttttgagtcttccagctatgcctttgaacacgttttcctgtctctatctttttcatcttgaaaatccacattcgctgctgccttttttctgatcacctgttcggtccttacctcctttccatctggcttcctctgtctatcgattgctctcacaaggtctctgctcagccactaattgccacaagttccaggaagaggcagagccggggccaggccaggaggcagaagccactcgggggactggggggccatgccgggggcagtttggtccaacaaagaagcgcttgaaggaaaataatggaaaatcagttctgaaaggtagattgagataagtagagctgtataaacgttgtgacatagataattgtgaataatattccactgtctagccctagaacaatttgactgtccagtggaaaaaccttaccagcaaggtggtttcttgaagaaaaggaagtttgccacacagaaagctccaactggttctaagcaaagggtagcacctgcaccaagtatcagggcatgaacctgcctcctgggttgtcccggccttaatcgtacttcattttgatcagatggcttgcagggttgctgctcacagcctatttctactatctatacgtccacatttgaaagccacctccaagcacacaccgtgcacgccctgtggagaggaagcatttgcatttctacccctcagataactgctgctgcccagttcatgtttcaagtatgagttccttcattctatcaccaggcttaagatccctttggtagatgaactggatgtttacatccattattgctggacagccacagaaccgattctcgcagcatggctgtagttgtgaaccttctccaggattctctaccacggactctgttcttgcctctcaccgtccacgcccaggtgaccgtgtcatccccacggtgagtgggtgccctccttcaccctcagaagccaccctgccccaacgtcagccctgccttagaaaaaggaccacagacctctccatctggaaagacaaagagaccacacaggatgaatccacaccaatccacgaccagtcgtccactgtggagagctctccaggccacctgccaccaagggctttcaatagcagtcaggagccagatgcatgaggctcggagtggctttgatgagatcttcaatcaccggttgaccacacaggccacagtgctgtggtagagaccctccctactccaggggccactgatgtagggttacctagaatttaggcagagctgggtagaaatttaaaaaggggaaaaaaaactctttattgcaaaagttttagaaagggaggctgctgaaaggatgttgattcttcttaagaaaactttctgcacatcatctttgcatttttgtgctaatttctactgcaatttattttctcatcccagcaagtagcaatttcaggtgacgtgacagtttatgaatgttacaaacattatttctttttaaaaaaaatctcttgaaatcagacttggcaatccagatacattttcccattcagtatgagtgggagcattttattagccataatcaagttttccttttcatgacaagaaagcttacagagacctgggaaccactcatataccacggggtttctttgcaattcatgtaactgaggaatcaaacccacatctgcgcctcctctggccttacttattgtcagaaagttcctctcttgtcctgtcagttagagcaccagtaggaactgagctgtgtatagtcagctgctagcttgagattctgacaaatctttacaaaaatacataggcttctatggccctctccttcatcacaagttaaacccacatgaaataatgtattatgagactttgcaaagaagaatgcaattcatcttactgagaaagcaaaaccctgccaggttgatttctttctcagtagcttcgtgacaatttcaaggaagccactgtaccagcacttcatttccctaaaacaggttatgactcttctttccctcatgcgttcggctcagttcctgagtggctgccgtatgccaggcaacgaactgggtgcttgagatcgatgcttttgaggggcttgtgttggagggagagagaggtactcaggaggactgtccttcactgtgacaatgctgggacagagacatgctctggggcctggaggacccaaggaattccacatccatgtgccagggactttgttggaaccaacgataagtatgcatttgcatgaagaggcatcgtgctagacctggggagtgacagacacacatgaagtctctacccaacaaccgatcatggggtcataccattgggagcctggaagctgctggaagcccaggagctcaccatctcccttcccagtagcaaagccaccacccattttacagatgagaatattaagacactcgttacgtctcacgcgagggcacacagctgatcaggagctgagcccacacaagagccagagttcctcccacatccgcacaccccagggcctgtgaacagcgctctgccctctcctgtgcacagggaaacaccaacatttttgctgacacagtcccagaaatctcctccacagacctaagtgtgttgaaccctagtgacgtcctagacacaagagggcactgcagtactgcacatttgtgcttctcctcgcaggaccgtgatgggttctgcaagtgactggtaacttcccagggaatggtgttgcctccaacatgtaaaccacacaccacatcgccactgccacaactgacaatgtcaagactaccctgtggggacacagagaatcgagccctccagttcgagaagtctttctttgggacccaatatttggcagatgccaggcagaatgctgagtttgtggagatgaggacagaggccctgccctcaagtagcctgaagtctaggaaaatgaatcccattgggaaaccagtcaagggacccaagcttggggaagggactagcacgtgctgagacctctgctaagtggaggcatctcactcacgccatgcaagcagcctgggctccgatgcacacaggagcagtgcagaagagtgagggtcccggggtcccagtgccctgccagcatattgtcgtagagacaggcacacacagccagcaggaggacagtcaaaggcagaggatgggatggcaaggtgtttaagaaagaccataagggctgtaggaagccaagaaaaggagtgtttggtaactggtaaaaatggggtgtggggaggaaaaggcagacaacccctcatcgagaaggagcaagaagtgacttctgtgtgccttggctgcctcatctacaaatttgggatagtagtaccagccttgtacggctgacgaagtgtaaattatttattatctgaaacactcagagcaggacctgttgctggtagacggtggtgatgctggaggggatgctgacattgatgctgatgtcatccgtcattgtagctccgactctgactccgtatctcagaggtggggggctctggtcatttgcaccaatttcctgtcatatggggagaattcacctcttgtttccgatgcctggcaacataaattcacatagccaccagttaatagcagctgatgagtttccattctgtgcaaaaaattacactaaaatgaccaaagattctcatagacaaaggaaatttaaggacaaaggaaaattatgtggacaaaggagttttattttctttctgggtacaagagttggtggtggccttagcagaactggatatggaaggcctgggctaggcctggatggtcccggggctgcacggatgtagctcatcttcacgcagacaagaataaggacgcctgtcctctgagtactcactgcccagtgaggtcatcagcaccgtttccaaacagaaacaagatgaagaaacaactcaatgatgagttgtgccttgccagggtgggcggacactcagcctcccctagctcataagctagcatctgtctctgtctccctagaaatcccagctgccactgaggaatatttacactattaacaacagctcccagccgggtgcagtggctcactcctgtaatcccagcactttgggaggccgaggcaggcggatccccttaagtcaggagttcaagaccagcctagccaacatggtgaaacctcgtctctactaaatacaaaaaaaaaaaaaaattagccagttgtggtggtgcgtgcctgtaatcccagctactcaggaggctgaggcaggggaatcacttgaacccaggaggcggaggttgcagtgagctgagaccatgccattgcactccagcctgggtgacaaaagcaaaactccatctcaaagaaaaacaaaaacaaaaacaaaaacaaaaaaaaccagctcccatttatttcgctctaataatggccaagaactgcaaagagcatctatgtcacttaccttttagaaacgacactattgttcacatttcacatgtgagaagagggagactcggagactagggttgcacggtggtgagcagaagcgctaaagcgtaaagtgcaagaccttcactagaccctgcctcttccgctgctgtgggatcgtgatgttcacggcaaagaagtaaagttgaatgtattcattgcagaaatgattatcatttgtgggccagcgactggaagagccccttttctcttgatgtgatttggggccagttgtctacggtctgagaaagactctaggagacactgccgcagggcacccctgccctgcaaaggtttgttgtgatagtgactgcttctgtgccgtatttcgctggcttgggggtgtctgaaaatacagtctaagtatgatatgtaagggaaagggagaatgagaatgacttagacgtatagggtcagtgtgcaccaaatggagctcttctgacatcaccttagagcagtggaccctaagacctacctctagctcccttttgtgacttatttccccacaaaatgtgttaaagtcctaatgcccaggaaataggatcattgtagatgtaactaattaaagtgaggccatactggagtaggatggaccccggatctgatacgaggggtggccttccaagaagaggagaagagacagacacgggaggcagacgctgctgtgcgacgtcagaggcagggaaaggaaggacaagccgcggactgatggcccccaccagaagctgaaagagctgccgccctgcccccaccttcatctcggacttctggcctccagacctgtgagacaatctatttctgttgttttaagctgcccggtctgtgggaccttgttaggacagccttaggaaactgatccagtccccaggtacctactcctccaaatccttcttcaaccacctacaatcctctctgacttaaggccagctgacaaggagcttgctttaaatcactaccttggagcagtggaccccaaagtgttttggtggctggattttgttagagacacacattctcaggccccaatcacaaacccatggagtcagaaacacagggctggtgcccacccgtgtccactttaacaagccatccgggtgattcagatgcagttcagaggctgagagcccagagtgtacaaaatgcccattctttgcttccaagacacacttttcctattttcattttctgaaatcagaatgcctcttaggcaatctctgtaaaatcttatgattaataaatcagtggttcatcttacagctgggggtgtctcagaatcaatgaaaaggaaggaatacaacctccacctgatatgcctgtgagtgctgctttgtttaagaaagcggcttctgatggtggaaaggattcctgtgattttaaagcggtttgtgtcccagcagtgggccctgtaatgagcacctcaggcacactatgaccttcaggaatgttcctccgaggctcccaaaccttccgctcatttctgatgcaccaaagctggcctgaggcctaatctctgggtcccacttctgtttaattaccgcgagccttgtttctgctgcctgcctgcccgccgcctgccgcccggctttcagaagcatctctggttctggaggcttcacttcgaagatgcagccccttgcatggaggggaggcccctggctgggggaaatatgcatttggtcgacgtgttttcttctctctcttctgccagtattttcttctgaagcacacagcactgcctcacccatgcccaacccacctggggagctgagcctccagataaaaatagtgtgcagtttggaggctggtgtttttgagatcgaacagctgttctgtcgcactttcacaacacggttattaaagcaggagagaagtaattaaaattgtcacttgtgcggctgttcgaattatatttccacttcctctccacagagcattcattatgtgttacaaaaatatttcattgtggtgttttacatcattaattttgtttaaattattcttaattgctcactgacatgacaaaaaatgaggaggaaattgggaggaagagattttattttaacaacaaaaaaactggaaagggtgaattttatttattttgattttgatttcacctcttttcgagatgagtttcgctcttgtcacccaggctggagtgcaatggcgtgacctaagctcactgaaacgtccacctccccagttcaagtgatcctcctgcctcagcctcccaagtagctgggattacaggtgcctgccaccacgcccagctaatttttgtatttttagtagagacagggtttcatcatgttggccaggctggtctcgaactcctgacctcaggcgatctgccagcctcggcctcccaaagtgctgggattacaggagtgagccactgcacccagcctgaattttagtaatgagtcctgggctggtgtgggcatgtctgtggccaacatgcacgtacacatgcactcacacatgtgtgcttattcacacacctgcatgcacacacacacatgcatgcaggcacattcacacatgcatgcacacacatgcacacaaacacatgcatacacagatgcatgcatgcataacgcacattcacacatgcacacacatgcacacacacacgcatgcataaggcacattcacacatgcacacacatgcacacgcatgcaggcacattcacatgcatgcacacatgcacacaaacacatgcacacacatgcataacatgcacacatgcacacatgcatgcatacaggcacattcacacatgcacgcacacatgcatacatgcatgttcacacgtgtatgcatacagacacattcacgtgcatgcacgcacacacacgtgggatgtgcatttgggatgggctggaattgagcgcccaggagccacagttcatcccactgctgagccagctctgggggtgggggcaggtagagtgtgggtaccagcatgggagtatttttctgtccctgggccagtgacagaatttgtggcaatttctggtgggcgaggcgctcttccttgttactttttcctcagttggtcttgtatagtgtggccctttatcttctgaaagaatgagactttgtgttccgctttcaacttaaacctgacaaaatctctgtatttctttcacttccacagctggtatggagggaaaactaaaccacgtttactctattagtatgagtatcattgctcatttctttcctttccccagtattggtgaggttttctagaacaatgattagccaagacccaacatctgtgttcatttcttttttctcacttccttttctatcatttccatttcaaagcaaagaaaataagactcttatattcacattcccccaagcgatcttacatttttttaaaaattgttcatttagtttaaaaactgagtaggcagcgtctccacttgcagggcactccagggacccagcagccacgttaggatgcttctcgggtcctgaggtttggttggtggcactccgtgttcacgaggacaggaatacaaggagaaaacagtaagcataatgacagcagtaaaataattcttaaataattcatggaactaagagcttccagctagacgatgtcaggaatgtttttagattcacagaatgttagagcagaaagaagttccaagatccgctaatccaaatgttttcaaacttgttttaagccacagagccccttcttcaaaaggaaacttactgggaagcccaatatggaaatagcggcttctcaagagactctggggactcgctttgaagatctctgatcgggttccattgccacattttgcagattaaagaaatgtggggccaaaaaggttaagtaataagaaaagtctgcttgcaggaaataaaaacaaattgcaccaagagccaccgtggaatagcacagaacgtgtacgtggcttatgtaagtaggtatttgcaggggcttctgtgcaagatgcccaggaccgcagcgggatgccttcgggagcagagatgggatggaaaagccgggcagactctggaaggcagccagggtgctggcccctaaggacgcacgtgcaagaccggataacgggaggctttgtgtgtgcacctggagaacagaggtgcctccttataagtgacctccctggactttaaacatctcacaaaatgtggagccagttctcaggacaacagcacatctggttggccggtgggtccctcgaggaaaagaggatggaagactggcgcgcaggaatgccagtggctcatacctaagaacaagtgttaagaacagaccagttttcatcgtgaacagggtttcagtaaaagaatactcctgttgttggggcttcttatctttcttgaagggtcttccactaaccctcaccaaccaaccatctcaccatatgcccattcgtccacagagccccaggcaacagagtgaatggatgttaatagctccttgattaaatagtaataagaacaagaaatacagataagaatgcaaataataacaatactagacacacctactgaagggttaggagggcatggcacattctaagcatttgatgtgtgttactatgtgatgctcagaacagctctttaagatgagtggtggtatcattcccatttcacatatgaagaaactacagagcagctgattcaagtaacttgcccaagtctactgagctagctagtggtgcagccaacactgaacactcaggtttacttttactttgtgataaagacatagactcacacagggagcaaacggagcccagtggagcccagtagaggactgagtctgtggccaaagtgcctggcttccagtgctggcgttaccacttacagttctgtgcctgtttattcctctgtgaaatggggacgtagcgcctcttgcctggggctacgttaaggaatgaatgagtttgtgcatgtaatgcactgggacactgtggacatgatcagcggggcgggattgttaaccgttgttgttgccattactgttattacggtggtgccacagaggagggaggaggcagagagccatcacagagaagatgctggggctgaatcttgaacactatgtagaggtttagcaggaagactgggagggaagagcgggtgctcaggcaaagaacagcacagcccccacgcaggaacgaggagtccagaatgctgggccacagtgtgtgataggtcaggtctacagaggtcttgtatttcacgtcaagagtttaaacctaagcctctggacagtggaaataactggaggtcccagtcagaggagtgccacatcacaactctttgtaaaccctcgggcaggagagtgggggacagcgctgaggacattagcatggagatgggaggtatttagcaggcacagtgagaggaactaatgaggaatcaagggtggaggttaagagaggccagagcgtggaacgacttccattcaaaaaacggggtttgcttgcgctacatcctcgagtccaaaaagaaaagcaggtgattttgtatcacaggtagcgcccaccaagtgtctgaagctttatgggtcagcccacctggtcatccccattgcttgcaggtagtgacatctcccaccttacagatagctgagaatggaagtcgctaccctcaggacacacacccagcaggtggccatggcgaggtgccacccacattcctccattctgctgtcacacggtggaccaaccatcaggggctaaagaggaggatgggcagcaacctcagcctgcatgcagactgaggaatccacaggaagcggaagcctttccagtctcctcctcactacagtgacctgtcccgtgtccaggtctgatcagatgtgaaagcaaagatggactcccatgtactccatgctcactctgttgatgaaaaggagcctgagtttcccaacacaccataatttgtacacgcaagcgttgtctcgggaagctgagcatttattcccatgatgagcatgtgctcggaagtttttagatttcctcttgtaaaactgtttttacgttccagactcatacggaatatacaactttttacttcttagtatgcttaactgctggcagcgttacctaaacatgaattttatcataccttcattaccaaacttcatttcaatgatcttgtgcactttttcaaaagcaaagctaacctctaacacaggtagctggcgatttagaggctattctagagaatgcgccgccaactctgaactgactctgccaagtgttcaccttcccagggaatgtgcaccacccgcgagttatccacccattcatcctatcggcgactgtcaattggcgacttgctgttaacgagtcaatgtacgttttcctaggtgggatgcaaagttgtacaaaatagattcctatgttccaagtacagttgaagagataagacataactagatcactagaaatcaaatcagaacttaattgctcggatcgaaagtcattgcagaactttgagttacaacatggcagactgtgctcagtgctatgacaatctgagggcgagggtcataccaggagctgcgagaagtatgctgagaaggccgggaagtggggccagacactccatccacagtctagctgtgggctcagtcggggcgaacgaaacagccagtgggcgctgtacctttcccctgcaggcttttgcccacccctccaagcaggctttgcccctctgcaggctttgcccccctgtagcctttgcccccctgtagcctttgcccccctgcaggcttgcctcagcgcacaaaactgaaatactaagttccttctttcatacttggaattctgtgaatcatgtaaaacacctgaaaacgtcactccaaggggcataaaactgatgctgtgagttcaatgcagataattcctaacccctaaggcttttacaaatcaactacccaaaggtacgagctgaattttgggaatgtactgagaaccttctcttttcttcttttttttatgattgggaaggtttcccttattcaaaatgcctatcatgagccctgagtgtcactagtaatttctagagcaagaggttccctgtgactataaaaagtcaacgtgccattgcctccccatcttttgtgagcgtgtaaaacaacccatccatttccacggcccccctcgagccgcgctcctcggactgctgtatgggaaataggatcactttcaagttccctggacacataaaattggattgaagcaaaactaaatgctgtggggcacggagtggagggggtggggacagcctcaatcccaggtttgatgtcagcgataacaaggtttccaaatcaaacggcaacaaaacctgtcggcagtgttgactaggaaatgctgtcctcggaacaaatattttaattatccgcagtagttctggtagcttggctagctccctgtttattagtatgataatatcacctcaatgtataaactttatgcatcaggcatgcataatgcatgaacgggcaaataaagagatctggagcctgttcgcagcgggccatgccaattatctcgctcggccagagcctgcctctgctcacagctgttctttgaaaccattcaccaatgcttaagagatatcagtggtgccagccaggctgtttgaatctccattgtttacatactaggagtttagctgctggttggaaattatctgtcacataaacatcctctgaggatacagacgagaggaagggagacaagccctgtctttatgaattttttttatttattctgatgacttttttcttttacagttttgtgtcctttttaattacttcgttttcctctggaattgtcacatttctccctccagttgagcaggtgaaaactaatgctctaaaatgcctggggctgcaaaccagagacacagaaataaatattttctgttcacaagtctgttgtgtaattcaaagcttttcttttggtaatctgattttttttttatttttgtccctctggtcacaggatctttacagggcaaaaacgaccttatatgtgggttgtgaattcacttgcttccatttgtttattttcccttccaggaacaatataaattttgaaagtcagatattgaacttgagccaaaatagtgtgtgtcaccaaccaaagtttttaaagggccaaatgttgtttttattgcggttatctcttcgtaagcaaaggctgagcagataccatcagttttctgctatcagcaggcgtgccattgtatatttcagtttgaacatcagggctgttgttgcatgctccaaggctgcaccagccacgaggcaggcttatttatcaaggacttaggaaatatgaggaccaggcagagagaatcctagtgaacacgtttttgctgatgcatatgttcacgtgaatttgggaacacgcacataagagtgtgtcattagacaaatgcatagagaatcagatatctaatatttgacctgaaccaggaaggaactcacaatgaaatatgattgtatgctttcatttaaaagcgtatcctaaatacaaaaattagccaggcgtggtggcgcatgcctggagtcccagctacttggaaggttgaggtgggaggatcacttgagcccgggaagtagaggttgcagtgagcccagatagtgccaatgtactccagcctgggcaacagagcgagaccttgtcttaaataaataaatatataaataacagcatatcctatgttccaagactagacctaaacataaagataccagagatattggctgggaaaaaaacagaaaagcaatcccgtgttctcagcctcttttctttcttctttcctttccctcagacttagaccagaacctctttgtcggtacaggcagacaccatctgcttccatcctttcccatgaccatggcaaatgttgacattgcaaaggcagattctgaccacggaattctcatctctggaggaaggtatccccatcacagagagttgtgacgaggttgagagaatgtctctaagagccgagtgcagtaccaggcagatagtaggaaaaaaatgttggctgctgttgtttttgctgaagctgctgttgctcttactaaaagtagaccttagcaagcctgtatcctgcagttgagatccagataaggaaagctgcttacctggaatcacaaaatagctggtcccctgaccccttctttacttacaggagtccccgcatagacctctgaaccatggaccgcgtctggtggttgtactggccacatggcatcaaagcgtattttcatgcaagtctgtcttccgtactggactctgagctccctaagagtaaatgctttgtctatttctgtctgtttccccagcagctagcaccatgccttgcacatggtggcatctcaatacctatttgttgaattacatgcaaagtaaaaaagaaactatgaatatgaattgtcagaagaatagcagctaagtggagtcctaaggtttagccacaagaatctgtgccaaggcaatacagatggattgtcttacaggcatcagagacaaaagggcaaaagcttcctattgtatgaaacaaatcatttaataagttttactgaccagacttgcataagatcatttggaagaagaggaaaacaagtaaaaaaccaatgtggtaaaaacccctcataggtgtccttggtaaaagtattctctgttgtttcagataggtttaaagtgttcctcttgaatggtaccagcttccccaaaattctgtgtatgttcttcgtgtgttcggcatgtcccctcttctctagaaatcttaggtaaatgctaacatgggtctagtctggccaaagtagcacaaattttgagtatctgattcctaattaggattctgcttctgtttccttattaggagaaaatgtattttgatttagagaaattgtattttgatttagatgttttcctgaattatttgccagttttcaggggccatcacagaaaccttgaggcctgtggtggtcctacagttcacatagacagtagtgggcatgcatcccctgggccagagaaaccggatgcgaaggcggcctgcagagccgacctcagaccaccagagggtctgatctcagggcagagactcagttagactgcctgggattaggaatcaacagatacaaaattatacagaggagctgtttttcaacttttgtttagtggcctccttaaatgtaattttattcacgttctttgtattccactagtgtaaagaagtattctatattaaaatatcagtgaagatggcctggttgtcatatggcttcacaaacagaatataattccgatcttagacatggagactgctacccttggaacttagtgaaaagggcaggggattccctatgtacgaacagagagaccacagcctgaattagaaaaaccaggactccaagaatggtcttgagagacctttccttagcctgatttaaatttgccaccttgatatgtcatagccaattataagcttgggaggtcattcattcattaaccattaatctgttcgtcaaacatttttatacaacgctgagtccaaggttcagaacaggtggaggggatgagacatggcttcgtggcccaaggatttcagaatgtgtttgtctttctgtctgtgtgagatggggttggaacacggtcagagcagctatggctttaaaattgcaactcagtgtgacacttgctattattggtacttatggcactttcttcaatcacaaattagaaagcacacgggagaaatacctgcagcaacgtggtaagaaacaattagcttctaaataacataaaaaacagcaatgccattaaagtggacgaaggatgagagagggcagtttgtagtcaggaaaacctatgagaaatgcaaatgtcaagggggaagggaggagggatagcattaggagatatatgtaacgtaaatggcgagttgatgggtgcagcacaccaacatggcacatgtatacatatggaacaaacctgcacattgtgcacatgtaccctagaacttaaagtataataataaaaaagaaagatgtccagctttactcaaaatttctaaaaattcaaacatttacccattagagtggttttaaaaacttttttaagatacaacctagatctccatacactatcagttggagagcaactagacaatatttactaaaatgtgaactgtttcgactttcagtgtagaccgtattattgttccccatgtttcacagcccctccctgtaaaaagatcatcctccaccccatggccatgtggcctgcagggcctctgtggagatacagactcatccctgctctgttgggaccaatgggatgcgtcttggccaacagcatgacatggccatgtggcctgcagggcctctgtggagatacggactcatccctgctctgttgggaccaatgggatgagtctcggccaacagcatgagagtggacatgaactgcaccatgtccaggacattttttagttatgcaaattatttttggtaatatttatttttaatttattttttattgaggtaaaatatacatatataatgtatatataaatatatataaataaattatatgtatgtgtgggtatatatatataatttaccagttttaccattggagtggtaacaaatacatttatattcttttctcccccttcatcgtgcatttctgcaagccccccttgctcatttccttttgttgtgagctcagcctgttccagatgaaggctgacctttcaaccaggatcctagaaagaagacgcatcctggaggatagcccagcagagcacagccgggctgctgcagacctggttaccaggacgcaacattagcggaaagtcagcttccttgtttcacaccattgagagtcaggagttatgtgtttgaaaccacaagattatttcatgaacgttgactataaaacctttttgaaacagcaactgcagtgctaccaactagcttaacgacagatgcagtcttacccgtgtgcaaagatatatgtaagaggtttttcagcaacactgttttaagatagcagaaaatgaaaggaaacaacctaaatatccaccagtagacagacaatggactcaataaattattatatttccatatgatgggatactatgcatctcttcaaaaatgaagttttacaacttttaaaaattatttacatcattgtatattatagtattaacccttctgctactagatgttttcgcttaaccttataatcttcatgttggcccatgtcgataggtgtagatctactaattcattctgcatgctctataatattctgccatgtgagtaactgcgttttattcatttaatctcctgctaatgagtagctgagtaatttcccatttgtgacctgtacatagttgctgttaggaacaatcttctgcctgccttcttgtgcacaggtgcagaggatgctctgagatgtgttcccaggagtggagcccgcaggtcatacgcatgagcatcttcagatgtcatggatattgctaagctgttctccagagtggctgtgcccactgacacccccaacacggcttcaccctcttgtagtggccagactagatgtcaagaccgtaccaaatatgttacattgagacatgtcatatcatactatatatggcatgtatattattatgaatacatagccatgtggtagaaatatcttttaaatatgcagagaaatgatcaacattaacttcaaaatgatggtcacttctgggacgagagaggactgggattagggaaggaatgcaaatgacatcgtagctatttgttatgtcttgtttttttttgtactcaacactacttatttattattgttttccccatattcttttattttgtttggtttggggctctttcatttttattcatcattaataattgcatatatttattgggtacaatgtgatgttatatacatatatacattgtggaatgatcaaatcaggctaattaacatatctgtcacttcacgcatttatcattctttgtggtgaaaacatttaaaactccactcttttagcaattttgaaatatacaatgcattattattacctagagtcaccatgctgtacaatagacaccaaaaggtattcctcccgtctaactgaaactgtgtacccttcgaccgataactcccttttccccacctgccgccccctcacttcagcctctggtaaccatctttctactctttgtttctacgaaatcaacatttttagattccacatataagtgagatcatgtgacatttctcttcctatgcctggcttatttcacttagcgtaatgtcttccagattcatctgtgttgtcacaaatgacacaagtcctttcatctctaagactgagtagttctccactgtgtatatgtacctatgttttaatacattcatctgttgctgggcaggtaggctgtctccatgtctggactgttatgaatagtgctgcagtaaacatggaagtacagacagctcttcaacatcctgatttcaattcctttggatctttacacagcagtgagatggctgaatcatagggaaattctatttttagtttttttttgaggaaccaccatattgttttatgaaatagttttactaatttaccttccccccagagcatataaaggtttccttttctccacatgcttgccgacacttgttagcttttttttctttataatagccattctcacaggtgtgagatgatatcttattgtgcttttaatttgcatttccccagtgattagtgatgctgaatatttttcatgtatctattttctatttgcatgtcttctttgacaaattcaggtcctttgcccatttttaatagggttgtttgttttcttgctattgagtagtttgaattccttacatattttggttattagccccttatgtgatatatgatttgccagtattttcaacacaattcatgaaatgtcttttcactctattaattgctttctttgctatgcagaaatttaggatgatgcaatcccgttcacctagctttgcttttgttgcctgtgtctttggggtccaagccaagaatcattgcccagaccaatgtcatggagctttttcactatgttttcttccagtagttttacaatttcaggtcttacactgaagtctttaatcgattttgagttgattattgtataaggagtgagataagagtccagtttcctccttctgcatgtgaatagccagcttttccaacaccacttattgaagagactgtcctttccccagtgtgtgtccttggcatctttgtgaaaaataaattaactgtagatgaattggtttatttctgggctctctatcctattccattggttgatgtgtctgtttttatgttagtactatgctgttttgattactacatctttgtaatacgttttgaaatcaggcggtgtgatgcctcctgttttattctttttgaacaagattgctttggctatttggggtctttgtggttgcatatgaattttaggatttttctgtgaaaaaaatcaatttccttctgtttctatgaagaatgactgaaatttggatagagattgcattgaatctacaaatcacttttggtagtatggacattttaacaatattagttcttccaatccatgaacaagggatatctttccatttatttgtgtcgtctccaattttctttcatcaatttttatagtattcagtatacatattttttacttccttgaatttattcctaagtatctttttcttgatgccattgtaaatgggattgtttccttaatttacttgtagatagttcattgttagtatacagaaacactgctgatttttgtgttgcattgtgtaacctgcagctttactgaatttgtccatcagttctaacattcctttggtgcaatctttatggttctctttacagaagatcatgtcatcagcaaacagaaaaattaacttcttcctttactatttggatgacttttatctcattttcttgcctaattgctcttgctaagactcccaggactatgttgaataaaagtggtgagagtgggcatccttgtctttctctgatcttagaggaaaagctttcagcttcaccatggattttgatgttagctatgggtttggcatagatggcctttattgtattgaggaacattccttctatacctacttgttgacagcttttatcatgaaaggatgttgaagcatttgtcaaatgctttttctgcatctattgcaaggattgcatggccttcattttgttaatatggtgaatcacatttactgatttgtgtatattgaaccatccttgcatcccacagctgaatcccacttgtttatgatgaatgatcctttttaaaaaaattgtttatttccataggttttggaggaatcagtggtatttggttacatgagtaagttatttagtggtgatttgtgagattttggtgcacccatcacccaagcagtatacactgaacccaatttgtagtcttttatccctcaccccctcctcccctttcctccaagtccccaaagtccattgtatcattttcatgcctttgtatcctcatacttagctcccacttatgagtgagaacatacgatgtttggttttccaattagtgatccttttaatgtaccattgaatatgatttgccagtattttgttgaggatttttgcatttatgttcatcaggcatattagactgtagttggggtttttggcgggggtgggggagtttggtagtctctttgtctggctttggtatcagggtaaggctggcctcataaaatgagtttggaagtactccctcacgttccattttttggaagagtttgagaaggactggtattagttcttctctaaatgttggtaggattcagcagtgaagccatcaggtcctgggcttttctttgataggagactttttattattgattcaatcttcttactcattattgatctcttcaatttcttcatgattcggtcttggtagattatatgtttttaggaatttatccatttcttcttggttatccaatttgttgccatgtaattgttcatagtagtcgcttaagatcctttgtacttctgtgttatcagctgtaacatctctttcatttctgattttatttgcatcttctctctttttttcttagtctggctaaatttttgccaatgttgtttagcctttcaaaaaacaaactttagaaaaactaacttaaaatagagcaatacggtgtgtaatgttaagattttgtaaagcttgcagatatacatgcaaccattttcatgttatttttgtctatgtttaaaatacgtgcttatgtgtaaatatgaccatgtatgtgcagacaaacatttaagaacattttagcaacatttaggttacttctgggaagtggggataaaatagatcactgttactttattcctttctttagtgtcttttagaaacatatattaagtttatgaattaaaagattaaaagcgactaattcaggctcagtagcttttttattgtatggatgagacaaaagacttaaaactatctacacctgtggtttttttcctctgtaaaatatggttagaaatatctactttgcagagctgctgtgaggatttgattagaaattattcataaaaatatctaacagcatgccttttacttagtaggcactaaataaataataattgtttacattattaataagaacataagagatattctgttttcaaatttattcaccctgaaatgtgcagagaaaatacttataggttctttatttttcaataactgattctttcttctacttgagctccccatgggggggaaatgaatcttagagccaagaaacttagtttgactcaataatttaaactggcatttaaatctcttttggtaagtgctgcctctttgggtataaatatgtggactttcagatcgctgttccctcactgggtagggggtgccatatttagcaaataaaaatttaagatactcagttacatttgaattttaggtaaaccacagataatttttttgtagtatgtcccaaatactgcatgggacacacttacagtaagaaaatacttattctttatctgagcaccacatagaaccaggcatcctgcatatcatctggcagccccatctgtgggtgaacagagaggggcaccacgttggggaaaagggccctggactcctggactttgtgcatggggtagagactggatccagtccttgggcaacagataggcctcttctctgatgtccaaggccagcatgacccacagtctgtgtgtctcagctcatctggacctgtggatgggcactggccagaccttccaccttacctctcaagggtagaggactccttgcatttctgccacatgctctttgggccctggactagggtgtccactctggggcctctgcagtgaggccctgaagccctcagcatggtgggatcatagcagattccctagctttcaaccagttgtcagacggcccctcagaagcgtgtggggagttttgatgatgaccgcaggaatactgaactccacccatccccctgcccaagatagtgtgcatgcttcagctttgctgtggccaccccttgtgagtccatggcatcctgggtccatagcctgaagcagagcgcaagcagcagccctggccacagtgttcccacagtgcatctgtctccctgggaccacccacttcccacttcctctttctccctgcatcttcccacaatccacctgagccaaagggacaggctctcctggctctcctgcctctcctgcctctcctgcctctcctccctctcctccctctcctccctctcctgcctttcctgcctctcctgcatgctctgtgctttctcattcagcattcactccacaaacatccaatcgagcacaactctattcaaaacacccttctcaatgcagaaaacaacagcagtgaatctgacacattcttgactgtctcggagcttacatcctagtgcagtagatgaggagaaggacagcaagcaagtatgctgatcattacatattataaggtcccaatagcgtagtgtgtggtaatgagttctacaaagatcaggaaagctgtgagaatggaggctgaccacatggtcatggaggggagttcctttagatgggatagttggagatggcatttgagtagacatttaaatgaaggaaacacaggccatggcagtgtctaggggcagagcatttcaggcagtgagaacaagcggctcagtgggaacaagcctgacatgcctccagccctgcaggaaggccagctagctggagccggtgagtgcagaggacagtggctaaagtaaggttggaaaagtcaccaggcctgcctcttaatgttttcaaaaagatatagaaaataattcagggagactttttttctttctttctggactctccttttgctaagaagaatcgagaagtcacctgcagagaaaacagatcaggggccacctggtcctgagttggaccttccttctcacttctcagggctgcaacattcctgcagctgggaagctgccagctagtgattcaaggaaaaactgaaatatagtttgacattttcaaaatattcctgttacatgaatacgtttttacaaggtgttatgagagacccattggatggagtgacatccttcctggaggagccagcagacttagcactgaggcttgagtaatttataagaacccataaagccatcctggaatgtgtgtctgtatggtaaaaatgatgttatgaggatataaaccaaatgtaatgcttcatagaatgatgttttatggcattacaataatctgaaaatatggactttgagttgggtgtgttgcagttaacacaggtgcagaggtagggagctgtgccttggcccccctgccggcctggcctctgccatcccatcattgattactcttgcatgaattcgggttctccaggctccgcacgtctatctacgtggcataagaaaagcctgttttcttgttctcggctaaactaatggcttcgtttttgttttcttcctggctattctctacccaacacaggtcctggtgttcctatggtgacggtgcacaacacaacagataagaaaagtaagtgctcttttttttccttaaatcttcctgagactcaggagaaaggaagcaaaacactctatgagatcagctggcccacattctcctactcagagacagagggatgagtcatgtcctagcagttcagaataggccatgctgatcaccaatatcaacgaaatatgatgaaagtcaaagtccgcatacccctgccagagggccccacaccccttcacaagtgctgagcctggagggtcattccaggcctacccaggtcatagactgacatcctctgaacagccagctcaaaaggctttgtagcctcacatgagtccgtccccactgagaacctgccatgtggcaccaagacttgaggggcacatggaggctcatctgtctttgtgggtctgggagcttcacggcatggagggtctctgcatccatgctgcacaggatatcagagaaaaacttattctgccatttgtaaaatggtagggaaggctttttcaggactgttgtgaaaggggagggagattcaggctcaactttgaatacagcaagatcccgtgggggtttatagccagtgaccagagaaaggggtccgtggatggaaaactgctaagagaaggcatcagtgggaggcgatttttgctaagctgacctcacaagatccttgctgaaggcaggacaaggacttaggctcaaaggtggaggacgaggaacagttacggagggtgatcagatatcaggggtggagacctcttgctaaagctgggcaatgcaggccgaagacaggttaggatcaaggttgaagcctggtcaagaagaggactcagaggagcctcactcaagtttggtcaaggagagtctttgaaagacttcccagggtcactagaggtggcatgtgtttgcttggagggaccccacacaggttgccacgggcacatccgtgtttacgcgagggatgtgtgctgtgtgcagtgggaggcagaggcacagcacagctgagaagcaaagagaactcgccctcggtccctccctttccagccctccctctgtctaacccaaagcagcctgtgtcctccttcccccgaatccttcccactcccttccacattcaggaaccccttccctggcaggagggcaaacttcatggcccgggtccgcagttcccctaggtctggggacagaggtgactccgtgtctccagtgaccatcgagcatcagcggctccctgattcctatctctgtggtggtacttcaagctccaggagaactggaggcggcggcggtgaggcgcatgttggaaaggaggctccaaacgtgtgtttagacaccgtgaagtggtcaaactgttccaaagtgggcaaaatagattcgtttaaagagacagcacttagccaataatcccaaataatgatgatagtctgccaagctatcaaatcattattagaaatacaaaaccaaagcataagtaatcataaaaccagaaataaattaatagattttaaagcccccacaaaaagccataaagtggatgtcagaatggatatacaaaaacactcagaatggccgttggagggaccccgtgctgagaagaagcgggatggccttcctgtgctcctccccagaggaggggctggtttccccagcaaaaaggttcacctgctcccaggctgctttccagcctcacctgcgaggtttgggaatctgggccatttgagcaatgggggcggtatccccggaaggatgttgggcgcgattgcctgggtctctcacctccccactgcatccacccaccctctgcccactctaaggggcacgaggctgtgaagggccctccaggaggccgcagaggccaagctagaacttccaccaaggcctggggtcggtggagtctgacagacatactccggcatgacagtgaatgtttgaaacacctgtgctagacctctttaggtggaattttccctgaaaaaatgccgatgttgcatagagcctcaactgtgacatcttttttttccttaagcaaatgtatattttcattttgagtatttgataagatttagagtccatggacacctttctggtatttgtgaggttttccccttcttgaaaattgatggtctggtagaaattagataaggtgtccaatggagctcacagcattgcagcctcccgggttagctgttgcccgatggttctgtgagatgccaccactgaagacccggaagtggagacacaggactctatgcactatttgtgcaacttcctaggaatctataattatttcaaatttaaaagttttttctaatctgtggtctaataaaaaacacaaaagtatctttcagctttgaaaaatatgatatagcatatggctcttcttacaaaagtcattcccttaaatgctttttacttctttggaggaagctattattaatctattcaagttcaaaggttaatatagtccctacttttgggaaatgcattttgacttctaagccacttccagcctggatgtgatcagtccttggggctcctaaagcctcccacggtgctggatcaagtcaacacagtttccaaggctcatgtgtgagtgaaaatgaagccggcctgtatcttaggtgtgtgtgacactgttgagaaaatatttcatttattccatttataaaaataaggtaatctataggtgggctgaggtgcaattcttcggaagagagtcccagtaagaattgaccaaatgtcttccagcaagtgcaacatgctaatatgctcaaagatccaggaaattttgttaactctgctgggaaacaaaacaaccacttcttttcctctgtaggactggctactacattaaccaatcaatccaatcaatattgacagaccataggccctaggttgccatccatatccgttgcggagctgcataaatgggaattttttaggaagcatttcgccgtttgcagttgagctgtcactttggtgactgtgactccctgaagcaaagagatgggacccagcggcttaagaaataaaaagcactgtgcacacaggatggggctggcgttacatgcctgtactcccttcttctctgtgtgaaatttaacagtgaacctgaaggtgacaccattgcgcttgatctcagcaaagtgctgactaattggaaactggacggcgtttagaattattttggtcacatttattttacgagcctatttatatagcagtgtttgactctgggtttcctggagcctaattcaaactctaggaatatttcatcccgccctagcctgtttctgcatttctggctgtcaatgtagttcaagctctttcaggatggtaacttaagctgccattttaacttggaaaaaaaaatgattaaatgtggttgagttgattgtcgttcccatccccaggaggacagtaggggtcccatcttgctcagtgtctatgttacattcagacttcatgatttgaggggttccaggttcctgaacacccactttttccccatgcctggataaaagtgcctgaaatcccttccttgcacggccatccctgagggttggcacatcatagctgcacgaatggctttgagtccacctgggaaataagagtgagtgtggcagggcctggtaaagtgccaaacccagccctgagttccagcctccaggtgtttgccatgggaggcgtgtggggtttcttcagtgtgtttaccttttgatatgtctgatgtcctcttgcagcacttcacagcccatctccaacccagctgtgtcttccccaaacaaaatgcactgagttttcattttgtctgtcaaactggtgcatcttggatgagaaggcaggtgcctggtgcttccaggcccccagttccagcagcatcttgttcgtggtgtggttggaccacatcagagcctcctcgtggcctctgcagtggatgaagggtccacagcatgtggtttgcggggggatgtgcatatcaggcagccgacaaagccattgtcaggccagcacttcacacatcagcctttgggcctcaggtaagcttgagatcagttgtcctctttcacgattgaaaaggccgctgaagacttccaggagcaacacaaaggcaggcagtgagtcacccatccctgcagatgcctgtttcatccaaacactcagccagctagcggttctgcatcgtcaggattctgcaaaaccccacaccacttgtacttgttccatttgatgctccatcctgaacaactcagacaaccgtgttctgatcagggggccagagaaaggctggaggtcacagggagccatggtagtaacaatagtggccccaaccagcatttatcagcacttgctccggggcagggtgctgtggcaaatacttgacatattttaactcatttcatcctctcaacagcctgtgaggcaggaactgctattatccccacttgtcagctaaggaagctgaggcaccacagcttaggtgatcgggccacatgcatgcagcgaggaagcaaaagcagaggagttgcatctcggacgcaagcagtgcggctccaacagagcctgttcttccagacatgtggtcattgcatggcgctgctcagccgcctgccctcatgcggtctgaaggacaactgcaaatccagagcgatgcccggcctgcactcccattgagatgagtctggggaggcagaagcagtcacacctgcagctcgttctcagcaccttctccgcccatacaccacccccggggtccatccgagccagctctggggtgagcgtgcggcacggcaccttctcctgctctgagaagccttccacgtcacagggaagagatgctcctcaggccctggtggctgttaaacctgtgggagccccgtcgaattaagggctctgcttcctgcagcagctcagcctccatgtgcaggctggggtcatactccatgcactgtgagagctcagcccttgaacttcaccctctaatggcagccccttagcccccaggcagcagtctttggctagccatccattattctcttttgaatgtaatcgtagcagcagttctgggctctccacacagcaccaggccccttccttgtaccaaccctatgaggttcaacaattcatctgagatccacagcaaacttcagggcgaggcccggactcttgtcttatctgactaccaagcaggcgctcttgactgtgggctgggggctgataccagatgtctgacaaggggggaaaggcagccccagaccccaagacccaggatctcctggccttcacgtcgctgccatctgggaaatgtgctcacagcagcagcctctgtgaccactgagctgctggtcaaaaatcacccctggtttagatcagccctggtgaggccatgccagcacaggcatttgcacctcacgcctctgttgaacagtgtgcaaagcagcagcgcttccaacccgcgctgtggggctgagccaggaaagcggggcccatggcctacagctgggcagggcaagacaggaggcctcggggagccggctcctgagccgctgtgtgacgccatgactggcagctgaggtgtggcccacgttctgttacagggcagagcctcggcactgtgcgtcagctagcaaagggggctctggaaggctgggacccgtctttatcatactatcctctcccagccctgctgtgaaatttgaaattactgtttcagaattctttgtcctttcccctcctctcccccactgaccccaaaaccaccctgggaatatttgacttttttcctctttagaaaatcttatctacaaacagagcctgcggggtgttcacagatgtgactctgaattatttaaaagctgtttccttaagaaggtaattatggttgggaccaacctatactcatttggtgcctggatattcaaacaaacaacttaggtactgggataaaaaaaccaacaaaatcatagtgaatacattgcgggctttaatgtaaatatgaaaggcaggcccacttagagacgtggatgccaactcgacgtgtgggagtcgaaattgcggtgtggcttgcaatgcagccccacagccatgcagagaaagcgtgcgtgtggcggggttgaagctggctacactggctgacagcaccccacagcggcctgcaagcgcatgtgggagcttgggatcactaggcagcctggttcccactcctttatggcatcaaaagttaggtttctctacctcctactctcttcatttgggtctttgtaagaaagcaaaaacagcccctaccaccagtggtgcccaggtgggtccatgaagcaacgccagatgcagttggtttccagcctctgttcctgcaccagtgctgctgggcgcacccctgccccaccttctccctgaggcaccccctcctagactgtcaaggctgtgcccacagctccccttccatcaagcacagggcgcccacacatggagagacatcaggagcatggcattccagagggcccacatgtcactgtcacgctacacgccaaggagtttgcccgccatcctgcaggacccaggaggagcactgtcagacgtccctctcgaaaagcttctggtcgctgtgcagagaatggatggaaggaccccaggttgcagacaggagggctgctgggggccatggtggaaaggatgagagtctggaccagcaggggggcctccaatgaggggctgcctctgcaggccctgcagggagagatgcacctggaaaggggccgaagagctgccatctcaatccagtccagggaggtgtggcacttgctggggtggcgaagcatcatacagaatcctacagcctgtggccctcaaaacctgggtcttgtccagtcctaacaaagaaggaacagccccgctgcctccttgggtgcagcagcaggcgactgggtgggtgtctggagagtaggtcctcatgcctctcaccctgcaggccaactgggcaaagccctggctctcagaaacagtggccaggacacagcgggcagctgccccatcacagccgtggagccaccaccaaggttggggccgtccagcaaatgcacaaacccatttcagacctggagataaaagccagctctttcctgcagatcatatggggcagaaccaaaaagactaaaaatgtaaaaagatgatgaaggaaagtaaatgttaaaagaaaaaaaatttcgaaagcagcctggtgcctaacttcagccctaggtcttaacatggctgcatcaggcaagtttctacctaagacccacagctttcaaatattttaaggagcaatttggtggccaaagagagaaagtctcattataaagtggcctttatgtgaggggaccttgccaagtcatgccaagacagaggacactgggccatctgtcctcaagtagtttttgctcatgaatccctaagataatttttgaaaaatcatgtttcccctacacatttttaagttgtcacctaaagtttttctcattaattcaaagctgtacaaaataagtttttagcatatttattttaaaataaaagtattacataatcctatgatatctaagtattgtggcaatttgatacttaccactgcccagttaaacatttctggaacaagttcttcttagctttacatccttccttttcctcctcgagctgatatttacattccatttgtccgcccgtcaccccagaattctgtcctaacgtcatttaatcttggaaatattttaaaggtcttttctttttaacttccggtgaccataaggccataatcattacttgttggatggaattattatcataattatcacttgttcacatcaagcaattaggatacattacatactttgataattgttggacataaaaagttatgattgctctgagatgcatctcttagcgagctgggtgtggtggtttttcactcagttcatgagcacacctgactcatttccagagaagaccttgtcagaaacgtgtgcgctcctggtttttccctccttttggtggtcgcttctttttgtttctgtagaatgtctgaaaatgtgttcatgtaaataaatggagagagaggagtcttgttatagcagtgccattttcactgaacgcctgagctatatgccaaaacattgtggcccatccattctctgtcattaaggattattttcaatgatctattgatttttagctcagtgagattccccttccattttgttaaaatcaaaggatgacaagccgaccatgttactgggggctcttacccattactgggggagttctcttactgaactcagccttggtggtccctcatccttcatgtggagcccacctgtgtacaagatgccccagggacagatgagggggctccaaggccttccttgccctcgtgacgcctgtgtcaggccatgatgaaagaggcacaggaaaggagcagttccttggagcgaatcaggcatgtccattctcagcacatttgccagcaggctcctatggatgcagagagcctgggaaccagtctcctgaatcccacgtgtctgcactcgaaatcttctggacccacagggttgcacgcgtgagcagctgtcctggtgggtggagtgtctgcagatttgctgttggaacgtgttagacttcagtccagcatttgggtgggcaagctggcatttggctaacacagagtggaaagcaagccacgcatggagctgcacgccctgcaggatgtctgcaggtgcttcttcctctctactacctaatgcgggaggagagctgggcttcgctgccacccagcagctctcggtgcctcgaggagcacctgcaggctgggcactgtgccagccactgcacccgctcatccgtgggctggaggacacacacatgagtcccctcaatgcacaactcctctggcatcaaacacctgccatgggcccagcatgatgctagaaggaccaaaaataaatgccacctactgggaccctgccctcaagttgcttaaaatctggctggaggaaaaaagatatggcaaaaagaataatagttgcccaaactgtgtcagactgactctaacaactcaacattcggagttcagagaaaagaggctgggtgctgtggctcacacctgtaatcccacgaaggtgggaggacctctttttcttttttgacctcctgggctcaagcaatcctcccacctcagccccacaagtagctgggactacagacatgcatcaccatgactggctaatttttacatttttctttggagagatcaggtctccctatgttgcccaggctggtctcggactcctggactcaagtgatcctcctcccttggcctcccaaagcattgggattacagacgtgagccaccgcacccgaaccctttcctttgtcttttctattttgttcataaagcatgtctctgttgatcactgcatgtatatgtggagggaaggacaatatgattttaagaaatgtaatatttagcatcttggccccaagattctacaatcctttcataggatttttttttttttttgagatgggggtcttgctctgtcacctaggctcaaggggagtggtgcaatcacagctcaagctatcctcccactgcagcctcgacctccagagctcaagctgtcctcccacctcagcctcctgagtaactgggaccacaggtgtgtgccaccatgcctggatttttttatgtttatattttgtagagatggagttgggattacaggtgtgagccactgcacccagcaaggaagatctcttgagtccaggagtttgagactagcctgggaaacacaatgagaccctacctctgcaaaaattacaaaatttagccgggcatggtggtgtatgcctgtagtcccagctgctcaggaggctaaggtgggaggattgcttgagcccgggtgttcgaggctgcagtgagttatgatttcaccactgcactccaacctggctgcaagaccctgtctcaaaaaacaaaaatggagctcagagaaaagagatttccagttaaggtgagtaagtttaaacagtagtcatgcgggctctgggcctgaatctggtcttcgaatatgactaatggcctagccctggggtaagcggacggcagctgcaagagcacagggagggggcgaggtggggcagagaggggtcctactgatggccgcaggggaaggtgcacgtgaggagtgagcagaaatacagcaggagaggcctggactagaaaggcacagaaaacccaggcaggggaagtcaggccaaggcaacagggagatgccggagagacttctgcctaagcctctgcgtgcacacaccatcctgcagttttatttcttgtagaaatgtgagaaagggaagcggctgctctctcctcttttagatccgttgcctattggtgttcattggatctggtcaccaattttccaaaatttagcacagtggtgattccatcaatcccctgaacctgccgggccacttggaagcatgtcttgcaacagtgcacagctacaccacgacctgcccatgggacgcagcgagggaagcagcctcatgagcaggcctgagtctctgcggtctcactgtgtccagatctgataatagctaattccaccaaatattagagggggctcacatttaattaaagagtggccatttgtgtgctccagactggaggtccccactgccctgaagtcaaaagaaaagtccttcagggaatatgccaatcttttcttatttctctgctgagctcctgccctctttgaatgcaattatgggaacaaataaaatggcttaactcaagtcccctgtgggacagtcagctctctgctgataaaaccagttgtgtgggcaatcattaaatgagaaatctaatatttaactaaatttaatagtctgttgctttggtgctttcctgtgaagggtgggatttcaatagagaggaacgaggtattcacacgcagcctgtgtagtccatgagcgattagaacatggtgcgttcccacatgaaaccagaactctcagatccggaaactggtaacgggctgtttggtggccagcctgtgttccgttagctctaggcaagcttaactcagtaggcagcagagaacattgctccctgagtttaaccttctccttcatgaccagcatttgagatcgcacactgacggctgaaacatcaaattcacatgcatatatatggagacaagagcgtactttaaccagctgtaagagggtctgtccccattttctctcagtttgagatttggccatccagacaggctcttgccactagcagacccccccagctgaagccctttctgggacccagaagcagaagctaactgatagcaagaagcccatctctgttctcattggtagggtctttctacctttgctcctgccagttcccctgatcttcatcggttgtcacttccatcatttgacccacatttgcacaccccaagttcctcacctgttttgcacctgggatgatcatgtcagcaggcagaggagcagagaccacaggttctccaagggttacagctgaggcgtcgagatgacctcatgagatcgaggcactggtctcctacaataagctggagtttggagcgtgtggatgaactgcctcatagtcccagagtcgagtgaattaacttaggtgcatcattagtctcctaaacatcagaaaattttccatcaacttctaaacaccagaaacttttccatcaacttctaaacaccagaaacttttccatcaatttctaaacaccagaaacttttccatcaatttaatgcagtttgctttgggtcctcgggtctgagctgtgtgggaaacactggttgatagtctggcctcagtttttccaactcttaccgttcaagagatctgagccctgaagacctttgcagcttcctgagacactcaggaggacctctcctcggtcctgtttagtttcctggggccacatgggaacaaggagaaagacttgggtagaaacccagactcgttaccatctaaagatgcttaatttccaagatatgaatcgattttccacaaacccatctaccccgggtacccaaaactagtgcatttcgtctctgggataggactgaacactgataccttggcgaggggtagggagaaggatttgctgccaggaaaatgaccaaaactttcatttggtgttaagtgtatccagagagcttgacaggtgcctgagatagggtggtcaggtccctcttggaggaggtaacgcttgcgttgatggaggagaaggagctagcaaggaagatttcaaacacagggcagcacgtgcaaaggccctggggcagcaaagagcttgggaaatgctgttctcttcattaccaggcagcactccctgctagtcttcctttcctgtaactgtgaatagaacatgaatgatatgcagtcactgtctcataaaccaactcctctcacctgagtgtgtgcctggagcattgcattaaagggctgagggcatttggactcagcaccaatgagtgctgccgcccatccattaggaacatgggctgaggctgtgaagctggcgcaggggcatgcaggccccttggggtggagtgcacctcccctaactcacgtgcatgcctgtgagggagagtgcgccacctctgcagccaagtctctgggtctcagagttaaggtcaagtctacttggacttcccttggacttcaccactgcagacaccccttgcagacgtagctgtgtttcctgctgggacacgtgtcctgcaagggacacgtttctcgcatgctacgtggtgttcggaacctttcccagtggtggtctaacgtcagatttgttaaaactctacctgtttgaaaactagtgtcactatttctccccttattttttatcaaagctcaatattcaaatgtgtccagcaacttgcaagtcattttcattttatgtactcgtcacaagcgctgggagcttccatttccccctgttcctctacagaaggttgccaggccttctgggcagagttcttgaataaagccacagccccatgttctccacacaaagccacacgtccagattctcctagttatgggcggtcatttgacctccagctgccccggagaagcgcccacctgcagagcagctttttttttttttttcaagggagttatatgggaggatgactggacatccattctagcattgtttgtgatcatttgtttacgctttaaacaaatgcacaaattgcagctgcttccaagtgatttgacgagccaaaggcaaagttccttgcagaaaaattccctttcacaatgaaccacaagttatccccatgtgtaggcttagtgtgagaagggagaaaggaagttgggtggtttttatgacacgtcagatggtgaaatgaaacagaatggccatttcagtacatgaacggagagttcctcaggggacttctttgcatctgaagaaatagataacgaggacgtgtgtgtgctgtcgcggcagaggcacaaaggtccagcgcatccacaccacagggcagaactgaccttggtctctaccacggagggaggacagccagtcccactgcagtgtgaagcaaggctcacacgactccactgtccacaaatacagtcaccgaagttaaggtctctccagagaccagcttatcttctgttttgggagagagatcagaatccattttatttctgggaacatttaataaagatgataccctagtttctacccacctttccttttctggttattatggccacaatttttggaaaaccatttgtcctaacagatgtgtaatgtaggttttcttaaaaccagcagtcatgggaagaatcataccaaaacctgtgcgtgtgacgccacggagaacaaaaacctctggtgggggaaggagaaagcctaagacggtggggagaatctttaatccacccaaattccagatttgagtctaggcttttgagcgcataacttgagcgtgttttttaatgcccagtttctttttctgtacactagaaataataataatcacctctgaggctgatgaaagcagcagttacgcacatgaaaagccatggcccgcagaggtcctccatgagtgaccactgcatctcagtgtgtccctgtttcctctctttcagaaatgtttgacctagaaacaaatgaacatgtcaagaaggccataaatgaccgacagatgcctaaagtggaatacagggacattgagattgatgattacagtaagtactacgtttttcccctctaaaagaaaaagaaaaagaaaacgtgggctgtgacacagtgcagtcatcagcagcaggtgccctgcaaggaagactccccaagcacgggggtgtatctttgcccctcagctcctctggcatggagtgtcttgtgttcagaaccaagatgctcactctggtgacaaaaccaaaaaaagcagggcacaggatctctctccctgagaggctgacagttgcttcaaagcaagaccacagactccaacgctctccttctttggtgaccgtgtcaagacaccgtccagaaaaacctcttccctctggaaattccctttctgtgccatctgaagtccttcctgcctcatcagctggtggattatgggctgatgaggggcgtccttgcagccagggtttacgtgaggaggtttgagtgctgttactccctaggaaatgcttctcactctgcctttctctgcctgtgcccttctttccttgaactgtccctccagtcattcggtaagttctcctgggcactaactctgtgctaggcgttgctaagcactaaacaccccagagcattagctggacctggactcacagctctaggagggaggcagagcctcggagcctcaactcccacctccgcacagatggctcccaagtcacccggctggccccgtgtcctcactgcccaccaggtcgttactcttggaaacccaagtgtaaaatgcccacagcggatttcactgtcttcccccagaactctgtcccgctccagacttccccacctctatgcatagcagccttttggtggtaagttggtgtcgaataactgagacttcaaaccttgaagctgtctttgagtcattcatgcagacaccacttacccatcacctctgaggctgtaaacgggtttccctcctgtgcaaactccgactgactgatagtaactgcaggagctctttgttgaaagggaaggtttccagagctcggcggaaagcgtgttgaggctgataagtaacactgagctgaaagggcagggggaggagccacacaccttgcgtttgccatccctagaccgtctctggaacctctttgtctgcccttccctgacacgagacagcagcgtgtcgcctggagcctagggtattcgctggcagcccccttgtgctcagcagcttagaggagacacaatcacctaacagactcagctcccaagagcaggtaccaaggctcaccccacgaaacaaaaacaggtcccccaaacagtacgtgctgcaaagctgcattgcgtagagcagaaagtaaatagcacgagaattcagagaagagcatgagactgggctggggacatgtgggaatgctcacggaacgtgggacttgaacatggtccctagagtcagcatcaggtgggctcacaagaggagaccgtgcaatccagagaagagggcaacgtgaggggtcttaggcaagggcaagtgcagtgcagtgtggctgggtctggaggctgccctggagtcccagcctgcaggacagcccaggtgtgggccctgcacagggaccctcactcgcctgtgctcaccacgccctccctgcagcccaccacaggtccgggccaaaaacttctggccccgccatttggccacaggaagctatgctctatcacaacttttctggacattgcattcacctctgaaagtcagaacattctggaattttgatgcacttcagatccgctcccgcccccacccccacccccacccctgcccccaacacactcacatgtccaaaggctgtctctcttaaaataccctgaaggtgaccacgccagggaagggggcatgaacgaaatgagtagggaatggtctaggagaaaaagaataattttgtgtgtgtctgtgtgtgagacagagtctcactctgtcccccaggctagaatgcagtggtacgatcttgggttactgcagccttgacctcccgagctcaagtgatcctcccacctcagcctcctgagtagctgggaccacaggcaggccacatgcccaactaattcttttttttttttttttttcgtagagacagggtctcactatgttgcccaaactggtcttgaactacggggctcaagcaatcctgcctcagtcccccaaagtgccaggattataggtgtcagccatcatgcccagcctagaggaggaagaagagaaattcaagaaaaccataaacaagggctgggcatggtggcttatgcctggattcccattactttgggaagctgaggagggcagatcacttgaggtcaggagttcaagacaagcctggccaacatggtaaaaccccatctctacaaaaaaatacaaaaattagccaggcgtgatggcatgtgcctgtagtcccagttacttgggaggctgaggcacgagaatcacttgaacctagaaggcagaggttgcagtgagccaagatcgcaccactgcactccagccttggcaatagagtgagactttgtctcaaaaaacaaaaaacaaacaaacaaacaaaaaatggaggctgtgacaagctgctttggccaagaaatgtgtgtattggccagtcacggtggctcacgcctgtaatcccagcactttgggaggccgaggcatgcggatcacttgaggtcaggagttcaagaccagcctggccaacatggtgaaactctgtctctactaaaaatacaaaagttagctgggtgtggtggtgcacacttgtaatcccagctactggggtggctgaggcaggagaatcacttgaacccaggaggcggaagttgcagtgagctgagatcgcactactgtactccagcatgggtgacagaatgagactccatctcaaaaaaaaaaaaaaaaaaaaaaatgtgtgtgttatcccagcccaatggagaaaccattgccccggcatgtctctgaagctcctctgttctcagctcgaggctcctccgcagccttggcggccagactgtcaccctggcaagatccctttctgagctccttaggcctggcctcctcctcctccagcccactctacccactgctgtcccagtaacgcttcccaagcctgcagcactggtgtgtgactgtcatcccttcctcttaggaaatgcagaaaagacctttcaaagcacaaagccagctttcccacccttgccacacactctgtccagcagggggtttccttaaaaggtgggtgggtacagatgccaggagaggatgtggggcacctgtatgagcccagcatcaggaagacccccttagggatcgcaggaaatctgaaagatgtcagccctaccgacctgacttggttttgtttttttactttatgctaccagaggctaatgcttttctttattttattttattttgtattttttagaaaagtaggacatcttccagaagggctcccctgaaatgttttcagccagtcagaacatggtttccaaggtctgcccttgggcttatcagtggcagggagcagcccagaccatgttttatggaatttaaatgatgaagtccaaggcctgcctctccgccagtccctgggccattgagctaatttgcaagccattaacattcagcccgaatcagtaatgagacgccaggtcagagctggctgcccagccagccacccaagcctgcagtgtatctgtgtagtaattgtattgaaaagccgctaattccaatttaattgctgtgcctttggtaatctgggttgtagttaacatcaacaaataaattcaacttggatgggaagatttgttggaaggtagggggcacagaagaaattggtgaggcaggtttttgaggtttggttcctacccactctccctcacccactggatttcatgctgctgaggaccagatccagtgaccttggtagccacgggatccaatgggctgtaccatccttccctggcttcccctagctgtggctgcagcatagccatagagccacccagcacaaacctgccaacagcaagacccacagatccacctggctctgcacagaggcactgccatgggccggcaccctctcccctctaggcggccccctgtctcccctgaccctctatctcttcctctccctgcctccctgctcccaaatatccatccccagcatccccgatcagatgctgagagatgcctttgttgccgcaggcagccctcctgctctcagggcaccatatttccctgcctgaaattctgctgctagcgagtgcccgggccatcgagtcttccgtgcattcagtgcactcccatatgcaagactgaatggaagcttcagagaaatgaagcttcacacaggtcgggtgacttgcccaaggccgcgcagcaggccagagtcctcaggatgaaaaccctgggccagtctctgtctgtgggcttcccctcaggccccacccagagcaccctcacccccacggtcacccaagggcatgcccgataccccgtggccagcattgccccctaacccgtgctgtgctctgcttctccccagacctgcccatgcagatactgaagccagcaaccttcaccgacaccacccactaccctctgctcctggtggtgtaagtatcgtcacatctgtctttccctggtgctcgttctggggctccgtgacacccatgataaaggaatattgaactcttaagaaaagataagcaggagaaatgacattgttgcaaactgaaaacataacatcgtttagcccaatgtcaggttctttaggaatcttggagacacccagaggttaaaggaaagtgggtgctgtgtacccaccgcctctccccaggctgcctcaggttctgtgaccataaagtgaggctgctgggatcatcgtagtggcattttgcatgacaggctcaccggaggctggcaggggacaggtcccaagacacagagacacaagatggctggagcctgggacccgcaccctgagcccgtgggtctcactggctggcatttctggccactgccgtgaatgcccttttttcaccagcaaagaattttttcagctctttcttatattcattaataaagcctccggtttgggttttgagaacaactttttgtgctctgtaaatgccttgaaggtgttgggtctgattagggaactcagtgctaggagccggcccagtgccctgtgcataggttcaaatgttgcctgacagccctgagtctaggtgatgtccacgcgctgacaccgcacggggaggcagtgcagagggggccacctggaccgttgagcaaatgccccaatgcacctcctggtctgtactttcaagaccacggagcaggagaaactcctgcacccctcgtagcctgggagagccggctgaagcgaggcctatgctgggctgtgttaaggatgccagtgcaactaccccctgagtaaacgctggcacctgatggagctctgattaaccctggtgtcttgccctgctcccttcctgagggctgagtccctaaatagcaaaaaggttccattatagaaacgccccagggcacagattccaatagctgattccgttttgcaattaacccactttccttaatatctggactgctttcacactttcccagcagccatgcatgcacactcacccacatgcagacacacgcacccacacacaggcacacgcacatgcacacacacccacatgtgcacacatgcatccacacacacacatgcacacacgcatacataaacacacacatatgcatacccacatgcacacacacccacaggcacacacatgcacacacacgcacccacacacataggcacacacacatgcacacacccacatgtgcacacatgcacacacacacgcacctgcatacataagcacacacatgcatacccacatgcacacatacacacacatgcacacacatacgtgtgcatacgcatccacatgcagcacatatgcacatgtatgtgtatatacacatgcacacatgcacacatctatacacacccacacccacagacccacacaccccacacatgtgcacacacaccacacacgtttcctgcctcctttctcttactaaaccagattttccccactttctccaggatgctaacaacttccgaaccagctttcttcccctgcacactggtttcttcagtgatcttaaaggaaatccccaaaagcatttcagtttacaaaacaattctccttcccttcagaggtaaaagtggtcgtgcccggtggagacagctgagctctgctgagctcggacgggaccggccaggcaaccccaccccctgggtgcacactcactctggccttgctagcttgccttggaggctgtgtctttttgtttgtttctcactgtgacatcaaatgtgatagcaaggagatctggagtccctgagcccctgcttcagattaaaaaaatccaaaagaaaacaaaggcacactcgacatagagcagcaccatgactcaccaggaccctaagcatgcagcactcgagcgcgccgctcctggcccgctcctcctgcccccaccccactcctcagcccttggcagacagctgggagagtgcccgtggtcgaagcagtcacctggctggagccactctcagttggggcactgctccctgctgttccagggaggcaggctggacctggggctgactttctctcctgtccatctttttcccggcaagagggaaaatcacttaaaaacttccccacacccataagtatgctggtcaatgaggaacaaccagtcctgcatagaaaatggccctgttcccagcctgggcaacatagcaagaccccatctctacagattaacagatttttcttttaattagccaggcatggtggcacatgcctgtggtctcagctatttggaaggcaaaagtgggaggattgcttgagccccagaggtcaagcctgcagtgaaccaagattgtgccactgcactccagcctggccgacagagtgagaccctgtctcaaacaaaagaaaaaaaaagaagaaaagaaaagaaagagagagagagaaggaaagaaggaggggagggagggaggaagggagggaacagccctgtttgaggaaaaagaaaacagccctgtttgtggcactggtcgaatcccatggtccaaatgccccaccatggatgcctttcagccagcagtgctgggctcgcaaatgaagagctgggaggagagcacagtgggagccgccagcccaggtcggaggccacactgcccagagccaatggctccttgactcccgagcagagggagggagaaaggccacccatatggcgggtttgctgttacttccgacttaacaagagacagaccacgtcttcaagccagggatgtggctagagtcagcgcggccttgtcacttgtgatgggtactgagaggtacagcctgggacatctagaacccaggaaagagaaaccttcttgccgtgtagggaaggtccccgcagggagaaggtgggaggatttgtattgtttccctcaccaaatagatgctttttggtggccgtcccagacagcgccggtgtgtgtagggatggccctgggtgtcctaggctcttggaggtctcctcttcctcctcactttatggggtgtggataacacctggctcacctgcccggggcaacagaatctggggtatggagttgagcgtgtggcagccgggtcacgggtaaaatcccttacgggggtcatctgacgtggcagctgctagaccagccgccacccaccacgcagcaggcctgctgagcccgggattctctttccagggatggcaccccaggcagccagagtgtggctgagaagttcgaggtgagctgggagacggtgatggtgagcagccacggcgcggtggtggtaaagtgtgacggccgtggcagcggcttccaagggaccaagctcctgcacgaagtgaggcggcggctgggcttgctggaggagaaggaccagatggaggccgtgcggtgagcacccgcccaggaagcaggagaggccgggaggggacggggctcctcatgggggcagcaccgcagtcacagtgcgggaatgctttttctccacgcacacatttttcatgcaatttgctcttacctaaaatctcttggccattccaaagaagtttcaaaggaaacttaggaatcttctcctagggacatttataactagttttcccactgcagggtagattgttgagttgactaaaacaaggggatagaaattgccggttgggttggcttggcttttctgcgctgtggtcactgacccgggccagtgtccacgcatgtctttgccatttatcccaaggggaggagagaagagatcaggaaggaaggacagaaaaagggaaggaatatgaatggggctggatccgtggaaatgggtcaccctcgttactgagagcaggacctccatgcacatccaggtggggccagaatgcccttcccggctctgaggaagggcaggcttttgttctgtcattcctgtgcatccctatcactgactcagcaagagcaaccgacatcacagaaacaaaaggaggcttagcaccaaggggcagatgctccaaatgacttattgaatcttattgttgcactggaaataaaaagacatcaagacactgcgccaggctgcagctggccttcaggctcattttgtagaagcagttttcacagtctgatggcacagaggactgcagcacttactctaacttcaccccttagagatgctgcaggaacagctcaacggactgtggacttgggttctgagaatgacaagaaggcagggagaagcgcatctaccagggacccccgccgcgaccatgatcatcaccgttatgggcaggggagcgtgaggctgggcccgggcacacaaggagggtggagcacagagcccagctcagtacatgtttattgactggacctggcatctctgtacctattataccagggtgctttgtgcgtttggaaatttttactcaactgactttgaaaacatttctcctcattttgaaaaagattgacggccctggtatgtactcagcgaatggtctttcaatggaaaacaatgagcgtgtgaatgaatggttccggtcctcctccagggagctatgagctgggtgatggcagacaaagcaattgcttcagaaacccgtgttgcagctgggaaatacggagcgggagagctctcaggactcagatactcagggaaggagtgtctgccaggatgcctttgcctggaagtcaatgactacaacaacacatgtgtgcgtgcacacacacacacacacacacacacacctctcaaataaggaactatattggctacaaaagacacagggatgtcaggtctcaaggttgatgaatccagacaccaacaatgtcaccaacgacccaggctctctccgtctctccgcccagccagccatgatggtctcatcctaagccgagccctcagtcacggggtggccctcagtagcacctggctccatgcttcgtcatctacctccagcaggttggggaggaaaccacttttagaaacttccagaaaggaaaggaaagtctccccacaagcagacagcaaacctctccttccatctccctggccctcccctgcccattccagaacctgccaccagtgagacaggtgcaggcagcccccccagagaccaagtgggtccgtctgacaccagtgtggggccagcccctgagcagaggatgtggggtgacaagggaatgctggggttcagtgtggaaggaggatgggtgggtggctgctgggtcagcagcgggcagtgccagccacagaggactcccaggacacggaagccggcccaggctgcgctctggagtggagtgggcctggcttcctgggtgggggcacgagtgctctcctggcttcccagacctcctcctttgggtctttttcatttgtgtgtggcttcccctgccatctcctgctctttcctcaccccacctgctctatctcctcccagggagatttggaagcccggggcctccccgccatcaagggcaggcccaggggaaagtcgcagcaccctcaggctccccttcgacacttggctctgcctggcatcttccccaaagagcacaggaattagagggcaaaggtgtttcacacacacacacgtcgtgccctaaaaagaaggaatgggcccaaccatctgttccaaaacaaggcagaacctgttctggaaaaagtcaataatgccaactcctaaaccaccgaagctcaaagaatgggagcgtgtggacaacggcaaagcttagagccgttgccaaagcacagactttcttaggaagctgatgcccaatggcgccaagccatagaaagcctccctcagctctccctaggaacgaggtctgcattttcattcatcagaaagaaatagcccaatttgatcggaaacctaaaatcaggaggctgacacattagcctgactcctcccactcccacagttcccccgtccaccaccaccatatcctcaccgaggagcccacaggccagcctcccacgagcagctgagatgagctgtggaagggagctcgtcccacccctgtggaaggcagcgggcagctgtgtaaacccgactagggccggtgggctcctgtctcctagagacaggttgtctctgggctcaacttgggattttcttcacgattgtttcttttgggtcctacgtgctcatgtgtacacacacagacaccctgggtcatgtgctaaggagcagcagaaatgcctcatttttatttactcatttgttcacgtagctagtggaggaagccaaaatagttatccccaaaatattgagacctgctaagtgaaagatactgaaaacacagggactctctgcctctgcccctgtttgccagacgccaggacatccatccttccttcctggggacagcacctgctcatcagcccagagagggtcccagccgttgccagggtctctgggggcagattgcattgccttctcacaggttccctccttttaaaagactgggggctgggcatggtggctcacgcctgtaatcccagcactttgggaggcccaggtgggcggatcaccggagtccaggagttcaatcaagaccagctggccaacatggtgaaaccccgtctctattaaaaacacaaaaatcggccgggcgcggtggctcacgcctgtaatcccagcactttgggaggccgaggcgggcggatcacgaggtcaggagatcgagaccatcctggctaacacggtgaaaccccgtctctactaaaaaaaaaaaaaaatacaaaaaattagccgggcgaggtggcgggcacctgtagtcccagctactcgggaggctgaggcaggagaatggcgtgaaccccagggggcggagcctgcagtgagccgagattgtgccactgcactccagcctgggcgacagcgagactccgtctcaaaaaaaaaaaaaaaaaaaaaacacaaaaatcagccaggtgtaatcccagctactcaggaggttgaggcaggaggatcgcttgaacctgggaggcagaggttgcggtgagccacgatcacgccactgcactccagcctgggcaatgagccaaactccatctcaaaaagaaaaccgtaaataaataaaagactggagctgctctctcctttgcctggtcactatgctgagagttatggctctttgttaaaatactgtgtaaacagggcccctacaccactgccttaagaggcactggaactgaggcctccgccacgtggagggcacagcgcacgccaggaaatctcttccggttttcctcttgttcatctgactttcattttcaggacagtgacagtgtctcgaccaggaactcataagggttgagaaaagaaattatattttctcctctttactagaaaatgtctaaaaatatctctaactccacacttgacattatggcttggcttgaggtaaaatccagacagacaataatttccatctaacaagcaacaagcccacagcctgcaggcgtcctgctgctggttgaggtccagaaaccggaaggaccccagccacttcgtgggggaagcagaagaccacaatgcggggcaaggtcccagcaagggtgaggcagggacccaggcagcactggcccagagcactgaggcccagagcaccaagcggctgctgccaaggctgggccgtagcaggaagctcatgggaagaatccctctgtggccaaacaggtacaagacaggggcctcctcccaggaattgggaacagaaggctgtgcaggtgggatggggtctcactggcttgactctgagcccagaagcatagaaccagagctccacagattcctgccgacccctaaggctcatcccagagcccgcgtgcttggagtcacaggctctgggtgggggcccaatagcagcagatggaccccatgcaacaggggctgcgtctcccagaaggggctctgcggctgtggattaatggctcgcagtcgagaagcttctatacctggaagtgctacagagttattgcaagggtgctttgaggttttaacgtgaacatgctgacttggcactaaataaataaaagcaataaataattatattggaatgctaaggttgctttttatttgaagaggggttttcatccttgaaatggatggaaaacatggctctgggctacaggaagacaaagtggcagcaggatgtgcactgaaccctctttcccctcctcgacctcacaggacgatgctgaaggagcagtacattgacaggacgcgcgtggccgtgtttgggaaggtgagtctgcgccaccctggtctgaaaacccctcagttccagtgtggcctgcaccattacccacgtctaatcctgatttattgagaacgtctgtggtctgctggtgagcaagtaattttttaaaatcaagagcctgggtgcttagtgattccagccgtgggaggtttcatttgatcagctcattttcctaagtttctttttacattatctggaaggaaagagaagggaagccaagtccccgcaggagagctctaatacattcctaatgacttttctcccatccatctgctgtagctcttggcatggtagccaggaaagaagcaaagcaggaatctatttctggataactcgatgtggagtaacaacgttaattaccatgtctacttagacggaagcacaggtgtggggagggtcgcgcagtgaactctcaaaccagagccgctcccatctggtggcccttgtcagaaggctgtagcctgggacagctcagctgtagctgaggcccacggtttggagttaggtctctgcaccgccacctactatggccctggtacatggcccctcattctccttagcctagacctggggcctcttgatctcaagaaggccagcacacagatgggtcggtatagacccatcttccctctgggagtgaccctcagcacaggccctgcagaggaggccttgctgtgacacccccgcaggtgaaggcttggacaagtaatcagcacagtgcctcttacgtcatcgcctccaaaacctcagagcccagcatgcactggagacccggccctgccctgtgggctgctcccggaagcaggggatgcaggagccctcccacacctcctccttacctgccggaggtgaagtggtcaggaggagggccggcggcttctctccttgttcagagcccgggcacagagccctagaggtgcattccaggtgcctagatgtccactcactgcctgtgaggcccgaagccactgggtcattggtaggtgtaacttgggtgtcaatagccatcacctctccccaccctcatggaagtgacttcccagcagactggcagctgaaaggcagggagcctgggccgtggtcagtcttttccagtcgtcactctgccccaaatgcacatggatgccactcctgagggcttggcctccttcctgtgccttgcatatagtccatccactcagggcctttcatagttcacttctggacacagagaggctttctcaacaggcagttggtccagaagcacaggcagccgaggtgccaaagggaaaggggaccctgtgcacctgtcagagcacaactgatgcacccccacaccctgtacccccgcactcagctccgccgaggacatctgtctgagctccgtgctggggatctttcctttgccattctgcccagtggatcccgggcgtctttccagagcataagcatctctgttttgttttaacaagccttagatagaggtccgtagaccccacaatggtatttctcctctgaagaataaagcgtcaatccttttagtggcttggcatgttgcggcctgtccattctgtttcctcctcgcatgtgccccagtgatctggctgcagcctttgtcaggcatcgcaggacctgggacacagagcccaggggagcagcagccaccctgcacccagaggtgacctggagagcaagggggcacctgtgcgttatgttctgcagtttcccccccgacaccgaaaatcccccctgcagaagattgcctgtctctcatttaaaccagagcaggccgcgtggccctgcaggaaaatgagatttaaagaaaacgaagaatgacaagtaaggacgtgtggagttcactgacaataaatattatttgtcagaaaatgaaaatcttctttcattgtcattagacaaggtgcccctgccctattaaaggaacacaccggaacgatcgtgcaggtcataaatggttgatcttggagtttggcatgacctgcgcttcacggtctcagtcaggtacctgggttctctacactccatgctcccaacacgcatgctcacagactcacatacacatggatgctcacccatacacatgctcacacacacatgctcacacattcacacacatgctcacccatacacctgctcacccatacacatgctctcacatacatgtgctcacacatacacacacatgctcacccatacacatgctcacacattcacacacatacacaaatgctcacatacacgctcacacatacacacacatgctcacccacacaatgctcacacattcacacacgctcacccatacacctgctctcacacacatgctcacacatacacacacatgctcacccatacacctgctcacacatacacatggtgtcacacacacgctcatacacacacatgctcacacacacgattacatacacctgctcacacacacacacatgctcacccatacacatgctcacacacacgctcacattcacacacatgctcacccatacacttgttcacacatacacatgctctcacacatgctcagacacatgctcacccatacacatgctcacacacgctcacacattcacacacacctgctcacacatacacatacatgctcacccatacacctgctcacacacacatgctcacccataaacatgctcacacacacacatgctcatacacgtttacccatacacatgctcacacgattacatacacctgctcacacacacacgtgctcacaaattacatacacatgctcacacatacatgctcacaaacacgactacatacacctactcacacacacatgctcacacaattacatacaccgactcacgcacacatgctcacacaattacatacacctgctcacccatacacacatgctcacatgattacacatgctcccacatacatacatgctcacacacattacatacacatgctcacacacgctcacacatacacacgagtacatacacgctgacacatgctcacacacacgattacatacacatgctcacacatacacatgctcacccacacacacgctcacacatacactcacacacacctgctcacacatacccatacatgctcacccatacacatgctcacacacacatgctcacccatacacatgctcacacacatgctcacccatacacatgctcacacacacatgctcatacacgtttacccatacacatgctcacacacgattacatacacctcccacatacacgattacatgcacctgctcacacacacacatgctcacaaattacatacacatgctcacacatacacatacatgctcacaaacatgattacatacacctactcacacacacatgctcacacaattacatacgcctactcacacacacatgctcacacaaattacatacacctgctcatacacacacacatgctcacacgattacatacacatgctcccacatgctcacctatacacatgctcacatacacacgagtacatacacatgctgacacatgctcacacacacgattacatacacatgctcacacacattcacattcacatgttcacgcacacatgctcacatgctcacccatacatacacacgattacatacacatgctcatacatacacgattacatacacatgctcacacaggctcatacacatgctcttacccatacatgctcacacacacacatgctcacacacaagcacacatgatcacacaggcacacatgatcacacatacacaggcttgcacaagtttacacacatactcatacatgctcacacaggcatacacacatgctcacatatgcacacactctcacatgtataggcacacacaggattacacatgctcacacatgtgcttatacacatacacccatgcacatgttcacacgtttatacacacatatcacacacacacacccccatatactcacacacacgctgccacatgctctgtctctcacacatacctgacagttccgtgctgtcccgtttccctcggggtcttcccttcggaggctgcagctcgtctgagcatccagccttgaaggcactgagcaggcaaggaggtagggcttttctctggggaggcctgcgttgcagtacggcttcctcatccccaccaagggcagggaagggcaggagtctaggacttacctgaatacagaacacctgggagcgtctgtctcgtgtcggccttgtgctgagcatgtgcagaccaggacttgcgccctaagccacttgttggcccctccctcagaatcatgtgcagtggcttggcctcacccacagacaagggaggcggtaagaaatgccataaagagacgctgagcctgaaggacagcaccttacacctgtgcagtccacacttgcctttccaattcgccgttgcatttcatcctcacgtcccttgacaccaaggcccagaagcggagaaggcgcacgtcgcataatgctgagttggaagggagtttgcttttcatctcttgttactgccccgtgaacaactttccaagtgacacattttgtaaaaggagagaacctgcatggaactggctgctctggggctgtctccctgcccgaggctgcttcatgctgagttactgccaggactcctaactgtcttctctctgcgctttctccaggattacggtggctacctgagcacctacatcctcccagcaaagggagaaaatcaaggccagacattcacctgcggctctgctctctctccaataacagacttcaaactctatggtaaatagccctgcaggaccaagcgacgggctctgctcccgccccgccccgccccctgcctgcgtggccccacagccctcccttcagcaccaccgtcccgctaaccacaggtgcctccaggccacagtcaccaccttgggctgatggaagaacccggggaaggagagggaagggtctcaggtaatatgttttgaatgaaagtggtcaatccccagatgcctacaaatcacatcccaatgaagaccacgagttggaaacagctagtactccgctggcagcagtgggggcgaggaagccagggtgcgcaggaggggagcaggtgccacaggccctgccgggccgccctccttctctgctcccagaagaatccgagcagggccctgccctgagttctatgcctgggcatgggtatttggtgcacaggtgttaccagataaggaagggatggttgggagggaattgctaccatagagcaattcaacgaggtccacgtggctcagctctgccttcccatctccctggccatgcaaatggcacctggtcagcacctgtcctcagagagtatggctctccatgagcacaaggcagagatggggtcaggctgtcagggtgacctgctgtggggatcagatggagatgagcccacccaggtgtgggaaccagacctctgtccaggcacagaagggctttgctgtgtttgggggttccaggctcctgcattctcctccttatggtcacccaaccctttttctctgaacctgagctctgtgacctgaacccatttcttagaatatacagagaggtcttttctgtggctccgagaacttgaattcaggtcagggctccgtggcagccaggctgttccctccagctgtccccaccctaagcagcgctggcaagtgaggtggaaatggagggggcttcctgctgctggtccaccgcagtcctgccagagcctgacattccctgcaggttggaggaacgagtccagcccccattgccacacctagccctagccctgctgtgctggccgagccctgtagacaccgcccagcaaggcagggaccacggtgggcccagcagcctcctggctggtgcagccaagtctcccaacaccttcacagcgggctcactccagtgcaaattttaactcgtacaggaactctcctggtccaaaatgtgaatcatgtaagaggaatcttccctcaggaatgcgggtgccaccttcaaattgagtgagactttcttaattctttcatcatgctgtttcagatttgtctgattcaaatgcacataaatctgaatcagattgtctgattcaaatgcacacaaaagctgccatcatgtcttgatgggtcactgtgcccaaaaccagccagtcctcttcattgtctcctgggcgccctcaggcttaccctgcaggccaggggcactgtgcagagccctttcggccctcagccctgggagaagcccctgacactcttctgtcacccagctgaccgcagggcctcaggcagaaccaagagcagggatgtgcctggactttttaaaaaataagtaaatcttgatggaaatgtgctctcttaccacccatgcccttcctaagtgttgaaggaggaggttatcctacttatttaggaatcagattaactgggttttgcttaattaaggttctgcgatgctgatgaaaattgcaacaccggcactcacacacattaaggttcccgttgtaccgcctgatgccccttgtaaagacccaaatgatttaggtggtgtttttaaaaaaccaacaatctgccacacaagtggcaagtgggaatgagcctgagtcctcaccccgcacccggtccagggccctccctagagtttgggggctgcgctcacagggcctcgaagccagaggtaacctccctccctttgcttccgtgcagcctctgcgttttccgagaggtacttgggcctccatggacttgacaacagagcatacgaggtgtgtatgggcacaactagagaatgtgatgagaccagtcagcctctgccacagtctcccagcctgccctggctgtatggcccactctgccttccccagccccatgcttctccctcaccagcaccaaagcccactcagaaacctccgaaggatcattccaccagagagtggattgaggttaacatggcctctctgggttccgcctgatttcccattataggacttgagggatgaggaagaaagtaagaggatatttgatggcggagtcagtcccagcgtccatggatacctgatgtgcacaggactcctggctctccctacagccagagctgtgctgctgggggagagtgagctttttttttttttttttttgagatggagtcttgctccattgcccagtctagagtgtagcagcatgatctcggctcactgcaacctctgcctcccaggttcaagcaattctcctgtctcagcctcccaagtagcttggattacaggcacacgctgccacgcccagctaatttttgtattttcagtagagacggggtttcaccgtgttggtcaggctggtctccaacccctgacctcaggtgatccacctgcctcagcctcccaaagtgctgggattacaggtatgagccaccacccctggtccgagagtgagctcttgactgaggagcagaaggcctctctgatgcgacctcctgagtcagacctgttgatttggtgcagctgtcagacacggcatttctccagctgtgcgcagggagggaggccagagctcctggccgaggcagcactgcattttcagagtggaaacttggacaaaggaactgagtccaaccagggagtcagctccctgaggctccaggtgaaatgatggccctctaaggctacctggagttggaggaaactcttcctttttcccttcttctcttccaccccctcctcttccaaaaagggagttaatgtgggggaaagctgggtgtggtatattagtccgttttcatgctgctgataaagacatacctgagactgggcaatttacaaaggaaataggtttagtggagaacttacagttccacatggctggggaagcctcacaatcatgctgaaggcaaggaggagctggtcacatcttacacagatggcagcaggcaaagagaaagcatgtgcagggaaactctgccttataaagtcatcagctctcgtgagatttattcattatcatgagaacagcagcacaggaaagacccacccccatgattcattcatctcccactgggtccctcccacaactcgtgggaattatgggagctacaagatgagatttgggtggggacacagagtcaaaccataccactgggcttctgacatctgccctgcatttctttgcagatataaggcatcccggttctccgggaacttagtgttttcaatacacttcacctaccttctcagtcaggtttccaagcagaacacctggctccctgcagtgcagccccctaactctgtccccttgcccccgcatgtgcagatgaccaaggtagcccatcgagtctccgcgctggaagaacagcagttcctgatcattcatcccactgccgatggtaaggactgaaaacatgaattcactgtgtatctagtaagagcctcctccttgatggcaccatgggttttaacaaatgtcttcctctcttttttttttttttttttgcacagaaaaaattcatttccagcacacagcagaactcattacacaactaattaggggaaaggctaattacagcttacaggtacagtacgcatgttactctgttttgaacctggagcaagacattcctttcatggagaaagacctgacgggtgttcagggccttctactgcagcagacacgcctgtgctgtggtggtcggtgatgagcaaggtcccagcaggttggaaaatcagcacatgctcaacgttttcttataattaatgatagctccgctctgtacttcagcccggtttaaatccctttaggacaaccatctccccgtactcccaccccagccctgctcccctcctccgggcagtgagaagaaccaagccagcacccaccctgcccagcagtgtggctggggctatcccgctgcggagagtgggactgttgttctgggttggtgagagtggtgctggtgggccctgagccttgccccactgcttccctctgaccaacaccacatgttactacgcactagcaggatgtcctggggccatctgtagctaggcagtagtgaaagaggggtacccttcccagaactgaactcactttcccacaaccaacccgtggcccgtccacaacagcatcaagtgctgacccagcagcctcaaacctgggctcttcccagtaatgcacagggatgtctctggaaacttctgccatttccttcctgccttctgctcctttggtggaacaggtatgacccaatggtctcttcaggtccaacatgaatgaatgggagagctccttggggacagatgacaggcaggcaccctgcctccctcagagagctcttgccctgggctgatcactgccttggcctccagcatccctgcctgtgggagggagggaccacctgtgggcttgatcaggcagggagagctccagccagaagggagttggaccccagtgtggatgaagaggggcagaaggacggggttacaccacacttgagttcccttgtgaaagacgttcagatttcagactttttcaaagtaagtgtggcagttgcatggcagtgttaagcacactgaccatggacgctccaaaggtccatgtgtatgtgttcatgtgggcaactccccaagatatggggcgagctgaaccccccaggtacagagcagcctgcatcgctgcaggctccatgggtatcagggagcaggacccacccagggacacacatgtgggcacagcaaaggccttcacagacaccccatgcatctggagccaggcccagccccaggtaagagcacgggagacgggggcctgaggcaggaggagaaagcttcctgcccatatcctcttgtactacttgatgttttaatgacatatcatagcctaatgacagcattaataaatacttcaaaataaagatgaatttcaccctccaaaaacatacaaagaaggcaggaagaggcagtctagtgtcatagaaagatgtaggttttgggccagatgcagtggctcacacctgtagtccctgcactttgggaggctgaggtgcggggattgccttgagctcaggagtttgagaccagcctaggcaacagagcaagaccccatctctacaaaaagtttttagaaaatagccggacgtagtcatgtgtacctgtggtcccagctacacaggaggctgaagtgggagaatcacttgagcccaggaggttgaggctgcagtgagctatggtaacaccatggcattccagcctgggcgacagagtgagaccctgtctgaaaaagaaaagaaaaaaataagatgcaggctttgaatccctgcacgtgcacagatggttcacggtgctcctaggagatggtggcatcaccgcattggcagtagaataattagccatcatcctattggcatctgggaccgaatgagcccacattccaggcctcattctaagcacggcacggctataagattgtttaattctcacaaagtgtcatgagctggagtctgtgattatcctccccacccgacacacctggaatccgaggctcaggcaagttaacctccacagtcacacagggagtagccaggacgcaaaatctgtggggtgggcccgtgggcacccaggacagcacgcagcccttccacgggagtttcccacactcagagtgtaactgagagagcataggagtgtaatggcgcgatctcggctcacagcaacctccgcctcctgggttcaagtgattctcctacctcagcctcccgagtagctgggattacaggcacgccccaccatgcccagctaatttttgtatttttagtagagacacggttttaccgtgttggccaggctggtctcgaactcctgacctcaagtgatcctcccgcctcggcctgccaaagcactgggattacaggcatgaaattctatttcttttcagagcctgacaccctgaaaacttgggctgcggctctgtagtccctaagcttgtatccatgttgcaaattcaagcaagcagatccggactgtagagtgttgaatgaagagcttcccaatgttttcacccagttcccactgagcatttgctgtgcctggagagggccaggcaccgggggcgtggtggtgtttgaaggctggttggcttcacgaatgggtggtgcatgtccacgctaggggaggcgcccctctgactgggacagccaggcagatctcccaggaggaagaggcacttccatcaggagtggcatggttagcaaacccacttcatcaactacaatccagccccggacggggcccaggtttcactaaactccacaccttctgtgcgttcccgtcccctggggagcgtatacctgggagagtaatttctccgtgccttccttgcagatttacccggacgaaagccattactttaccagctccagcctcaaacagcatctgtaccggtccatcatcaacttcttcgtggaatgcttcaggatccaggacaaactgctgacagtcacagcgaaagaggacgaggaggaggactaagctcaggtcgctctaagcacaaacgtggctctttctacaaccagatgcaaccgagggatttccctgccctccctcttccctcggaggggcggggcggggcggggccgggtgttccatagcatgtgtgtctcggatgcggaaggcagttttgcttgggaaacaagctccttccccggggtcatcactcacggcctccatggcaccagggacaacgctgtccccgcagcagcgcctcctcccggcgcccgagagaccggcacgccacggcccctcccccaaggaacagagcaaaggatggtggccgcaggccccacgcgagcccacaggacaccggcccctagattccagccaccaagcggaagcatgagacccgcccacactagcctctgtgttcccgttagggacatcacaccctgtctcacgtcgcagtgccatggacgcagcagttacagcaccattgttttagcagtgcgtgttcatatatgggcttgctacttcctgtaatgaggacgttcaacatggtgaggggctacaagaaaacgcttttctgtacagagtcttactgtagctacgctaatggttaacctgatagaattaactcgtatttttctatggttttaacctgatgctccactgtctccgtcatggggttgttttgctgtttggggttgggccttgtttccctttcctttctccagtccacgtgtagactttgcgcttgatgaagaagcagatcggaagtaactgctccctcctcaaggttgtcttcagacgtcttggggacgttcctaaacactgagggggaagacagccaatagcacccattaaaagaaatacctaaataaaacctctctcccactcagctatgctagggcttggctgtaggtgtgcactgtctatttacatccgtccttacaaccatccttgtcctccttggtaccgtatcaagctctttcccatgacatttggtttaaaaaaaaaaaaaaaaaaaaaaaaaaaacagaaaaaagacaaagcgtcaactccacccacaggcccgctgtgtgtgctcgggccacgggagtcctgagggttctgtgggcctgcgcgcatccctctcccatcgtgggggtggctccgtgaccttcctgccacgagcaggaggttgatgatgtgctacgttagccttgtaagatacacccccaccaaatgtgcagccggtgttcccagtgtatatttcattctcttgtatataaaggaagcaatgtgtgtcaggcctctgtgcagtcaacccagcctcctcccgccagtgctaaccccgtgttgagcctgcatgctgacactgtggccgatctggactctagaagtgctagtttgaaatatatccattactgtcatttccttttgagcttgtggacaagctgaatgtcaggactgacttcgccagctcccagccctgcgggggtgtccttggcatcccatcagcagaggagatgcgtccctgttgcattttggcgtttggggctttgggtttatccacatgagctctgaacgtccgttatagttagggtgattggaaggtctccatcactgggtgttttaaaggtgattcaccaccatttgtgaaaggaccaacgtgctgataaacaggaccgatccgagtgctacatgactgtgcgtttgctatttcaatgggcctgaacgactacaaagccagctaggtctggaaggggaagccagctctggccacgacatctggtcggagggaagtggggatgtggcatggtagcgtctgttcatccatggaataaaacattattttacca

SEQ ID NO: 408 - DNA, 84845 bp, Homo sapiens
acagcggtgcgagctccaggcccatgcactgaggaggcggaaacaaggggagcccccagagctccatcaagccccctccaaaggctcccctacccggtccacgccccccaccccccctccccgcctcctcccaattgtgcatttttgcagccggaggcggctccgagatggggctgtgagcttcgcccggggagggggaaagagcagcgaggagtgaagcgggggggtggggtgaagggtttggatttcggggcagggggcgcacccccgtcagcaggccctccccaaggggctcggaactctacctcttcacccacgcccctggtgcgctttgccgaaggaaagaataagaacagagaaggaggagggggaaaggaggaaaagggggaccccccaactggggggggtgaaggagagaagtagcaggaccagaggggaaggggctgctgcttgcatcagcccacaccatgctgaccccgccgttgctcctgctgctgcccctgctctcagctctggtcgcggcggctatcgacggtgagtgagattccgcgtcccccttggacccctgggggcaccctctccccagcccccactcctgcatacggatggggaagggagacgcgggagggggtgccttttgttatcccagtccagctgacacagcagcggcccgactgggggcggggatggggtccgatttgggggatgggggccctgggcaaatgatgcttccggggccccccagcacaaacaaagaccagaggcctgggtagagagaagagggctccccatttttctgatcctggggaggagaggccttcttttcctatctctgttcggggagggcctccgcctcccctacatcctcacaaccccccaccccccatctgaattgtgaaggaatccggatttgcaatgttcggctgcaaaagggggtgggggtggggggggtggcttttgcactggcctctgtagctcgaaaggggagccaggccaggggtaccctgccgggcagagggcaggcaggcccgggaaggctgtgggtggggagagggagggccccctgcttgggcgtggaatcgaccccagagccccggctggaggcctgggtgctgaagtaggctcttccccctctcagggcctctgtcagtagcctggggtagggctgtgttggggggcagagagggggagctcgccatactatgtgactttgaattttccttcttaattcctgggagctttgagatgaaaaaacgtcagatgtcatcactggggaaggggactggagaatggcctggaatgctggggtaggagggtgggggaggctgccttcttcctgacttctggcttcatcacagtttggattggaaggagagttggaggttggatggggattatggctgtgcccccacactcctttagtaaatctgtttattccctgcacccctccaagcccaaaaccccatacacacacactttgtatattgcagagttaggcttaggctagaactgcatccttttggggaaatggggtgcctctcttccctttttttgtcagctgtttttttctcctacttgtgagtcactggttcaagtcttgcccaagctttaagcattaagctggggtcatggggttgggctgggctaggtccctgatttgagaaggggtgggatctcatcccctcctgtcatcttagccctctcatccaaagacaaaactgggctggataccatcatacaccccctcctctgtcttgccagattgggattgggaaagtttttctctgaaaccagattatctccctccctctccctaacttgcttcaattgggggaggagacttacagggtcaggaagcagctgtgtccccaaaaaacatatttagtgtccctcagttgtgccatcttggggactctctaccccccacccccaccccaccaattagctgccccggaggaggagaggggcttttcctgaatatcctccagatgccgcacagccggcttctgcctataactcctgtcattatcatgtgtttttctcttgttctcagccctgtgaggtgagaagggaaatcgaggcagggagattggggttgcagccgcttctgggaggaatagaaaaaaaatttgagagagagagagacccatcaggagccccttgaaggagggtggctagagttaggcagaagcaagagggtttctgtggagagcagggaaggtcaggaagggaccccagatagcatcactcccagggctctaaaggagttctatttgccacaccaagttagtggaagagagagactggacatgttctccttaactatctccctaccctttcttaaaatgttcacccacgccccctctgtatctccagctcagatcaaactatccaaagccccaggagaggacccctccccaaacacacaccaatatttctgccttgggagtgggaatataaataatcagctccaccccactcttgggtacagggtggtgagaaaggggaattgcatagaaatgtaagttcaactctatccagaggcagcctaggggatcccttatccctaacccctgccctcttgcctcagggtccatcaacattgaactttcttgtttactttccagagaatggagatgacccagctcacctgacttagtatgttaccttcctcctgctatcacagccttgctgctttctctccagggcagcaatcctaggggctttcccacctcttctgctttctcttctatgcctgaaactgcctctggggtcccctgccctttggggagtaacgtcactccccactagcgacaaaattgagtgtacctgctgctggagaggttgcagaaagatggggtggagaatgggactattgagggccctgctgagattggggaacattttctagtggggagggcacccccagacaaatacagctcacagaataaggctgacttcctccctccctttttcctgaccttcctccacacacccccttgagccggcatattaccagttactagagtaggtacagtggaagtgagttatgaagctggggtgttagcttcctggatccctgagagaaagttctaaactcctttctccctgatcagactcacatcctaaacgtctccctttgcctcgttgtcttttaaagcaagaatgtgtaagaaattcattttggggttggagggatattttgatgtttagggctgcttcactagacatctttttcttctgatcttgttctctctcctctcttcattttctcaaccacccttccaccactgagcctcccaaaggatgacagcccaggtcctggccagagtcagttcctgtccagatgcccccattcttcaaaaccccttccttaccttttgggaagcccttccttactcaagtctatctctctttcctcctgctgcagtgtgagcccttgcacatcagaacccccaagcctaggtttattcccgcccagtactctcttctcagggtcctcctcactcctcagactctttacctttcaggtcctccagctctgcgtgtgggctcattgctcttggggcatctgggtgcagctgaatggtactgcaggaaggcccctgacttggtagtgctgggtatgagcgatagagaacctgcctccctcttctgtcccagatttcagcctggttagcaggatcctgcattgtttggagaaggaagcagttggctttggagtgtttccggtgcaatggcctcaggcaccaatataaaccctccctgggaaagaggtgaggggtatatgtggagagttgtccctcttgctcccctaggggagatgaaagcctctccctctcccaccaggccttagcttccctggctgaagagctccattttcctccctcctttctaccctcctgactccaggggtggtagtggtccctattctgggtctcccttgagtcaggcactgcctagggccgagactctgtctctccaagataggacagatcttgctcccaccctactctaggctcagcggggtagtcattctctgggttcatcccaggacaactgtgtcatccccttggcaatctctggactgagcccccttcctggcttttctggctgtctgtctgtctttctgtctgtctgtcattagtgtgcgctgtcttggctttttagaacctctctgtctctcaccctctcagttcatctcttactgccgaacctttgtgacattctctgccctgctttctgcgtctctgtcacttgtcttatttttctctgcctgtctccatttacccccatccaggcctcttggtatcccaaaagcttcttgggagcaagagtctctctgggctttcccactcaccccctggctccctcccctctgttttggctatttttcccccttcctggccagacccagtgtccagttcagcaccaaaagtttcctctccactttcctccgacttcctctttcttcttccccctccactaatttggggaatgggttttggagagaatgtttctggaagaaaggaacttgataccctttgtgggctaagagggagaaaggaggtatttcagaaggaaggagggaggttagacttctggcagaacttcctcctgaccaggagcctaagaactggagaaagatgtaaggagtgagtcaagaacttggagcttttactctggtgagcataagctgtgtgtgtggctggggtggggggagaaggagaggaggcttagaaatgcctggtgagtgatatggtgacctctggaggccttctgggggtctggcttttatttgtggggaaaggaaaagctggtgggggaggtcacgggtcaggctaatgtcctgctgcatcaatattgactcagaatggaagcggagacccttcccctcccctggctgtccaagccaccctgtctgtctgtctgtccaggccgcaaagcagaggcccagactcaggaatgacaaaaatgtgtctgagcctcaggaaagagccactgggcaacacccaaaatacaaaaaattcagtgaaaacctctcggtttgggtttgggaggcccttgctgccccacccccataaggtcgaaaattcagattcctgcaggctctgtccccgcgccgcccccccaccccaccccccgcaccttgagcatcctcctcccactctgttcccttagctatatcatgtggttccctttagagaacccccctctcacctagctcagaggggagcctatctctccttctgctgtgtccactcttaaaaagggccccaagagtccctgtcatgcttttgcagtccctgagtctccttgtcctttaagaagcacctctaaggtcttagctctcttccttgctctcgctccctcaagggggtatcaaaggatgggttcccctcctctggagaagactccttcagggttggacttcgctgtcaccctctctggccaggcattctcaccccacttccccacccccaaggtcccagaatgggacacagaatgacagccaagggtcaagcagggcagtggggtctgtgttgtgtctggacgcacacccaactctacacctcctgccctggctccagcttggtggccctggggaccgtggctgggctgggtgcctgggtttgggggggtggggcagggtgttggccaagttagcatggcagtcacattcatcttcaggcaaagccgagaacagacggcccctgtgtcctggtgttcttcctccaaactcgctctctctccttcctctctagatctctccttcttcttctcctgcctgtcttccccttcttctgtcccattcttgctcctctctgtctcccctatgcccttccctcctctctgaggagccctgaaggccaccccttaaaatcctctccccactgccagggccagagaacgacagcgttctccctgcaatttcccttccttgttttttgtttttgttttgttttgtttttgagacacagtctcactccatcacccagactgaaatgcaatggcgtgatctctgctcactgcgacctccgcctcctgctaatttttgtatttttagtagagacagggtttcaccatgttgcccaggctggtctcaaactcttgacctcaagtgatccgcccatctccgcctccacctcccaaagtgctggtactacagacgggagccactgcgcccatctggtttcctttctttctttcttttttttttcttttgagatggaatctcgctctgttgcccaggctggagtgcagtggcgcgatctcagttcactgcaagctccgcctcccctggttcacgccattctcctgcctcagcctcctgagtagctgggactacaggcgcctgccaccacgcccagctaatttttcatatttttagtagagacggggtttcaccgcgttagccaggatggtctcgatctcctgacatcatgatctgcctgcttcggcctcccaaagtactgggattacaggcatgagccaccatgcccggcctggtttcctttcttaacccggctgcatcccatgacctatgaggaaaccacctgctcagttaccagtcaccctgtgcctcagctcccccatgtgtgagaggggggccgcaagggcacccacctcacagggttatagtatctaagtgagttaatagtcaccgtatttccaatcagtggctggtggttagcaaggtgaaaaaggttagctcccatcggtcagggagacctccgggttctctcatgcgggccaggaggcggggaaggccttagttgcttttgaccttagggcaatgttgttctctcatctaaactgcaggccacaaaggtgggttttctgggtgctggattcagacacagaaggctctgctgaggggagtggggttggctttccctctaagcagattataagggtcctaccccgctcccaactcagctctctcccagctctgagtgaggcttcccttggctgtgtagactgtcccaaagtagtttatttgtttctttcttccctctccccctgaaggaaatcaaagacaggcctcagccttctcgctccagattcctgggcccttcaacaccagccctgacaggaagttctttcacgtatctctctgcaatccttgtgctggccaggccctcgggagatgtggccccctcccccggtgctgctgtgggataggggcctgggccctcctcttcctttcacttgtcccatcccccatcccctccctgcaagagcacatctggtttgtgaatctctctcattccagcttttggagtttgccagctgctgtttcctctgtggagttcaggccaaaaatgggggtgggggacagcgggggggactcagtgagggctaaaggagggggcaccatggctgggatgtggaatggaggggaggttaggtgaccacccggtgacctcaggccgtggctgtgcgctctgcccctgggaggagcagggcatggaccaagtcccaggtgggtggcacgggggtctgtttctgggctccaaacatctcatctgcctctgagtcccattccagcccccctcttccccctcagccggccacggctggtcaggggaagcggacggttctccggcatgctaactaggctggcgggctgtgtttcccgggaagacctcacagctggcccagtggggcaatgaactcagcattatccacctcctcaaggggcctttattccaggctcagggtgggggccaggggagggaggctgaagggggagcctggctaggccatccttgatgtgtttcctgaactcggtcattttggccaggggcctgagtgccgtctcccctgccagcggtgggggttaggagggaagacatctcagtgaggctcccatcagactccctccctcctaagagccccccccccccgccattttccttatacttctgtctctgccctgcatttgcattagttgggtacagctgtcttctcaggcgactctggctcctgcagggcagagggtcatctcaccctccttggcaccctgatgcctagtgcagtgcctggcatagagctggccttcagtgtgtgccagcagaatagaaatgtgatggcacagtctgaggaaaagccacgaaaggccaggagactgggagctcagccttgggtgggggagaaggggtgggtgactgttcctcctgtggaggatgtggtgatagaggttgggaggagtgggaattcggaggactggtgtggatttcactggttcagagcttggagtcagcttagctggttttgtcacttgccagctatttgaccctggccaagtcacctggctcaatttcttcatctgtgaaatggtggtattagttgtccctatttgtcatactgtggagggaattaaatatgatgatacatggaaaaaactgctttaccacagttcctggcacatactgagcccacaataagagttagttgtcagccgggtgcggtggctcacgcctgtaatcccagcactttgggaggctgagatggatgtatcagatgaggttgggagttcgagaccagcctgaccaacatggagaaaccccgtctctactaaaaatacaaaattagccatgcgtggtggcgcatgcctgtaatcccagctactctggaggctgaggcagaagaatcacttgaacccgggaggcaggggttgcagtgagccaagatcgtgccattgcactccagcctgggcaacaagagcaaaactctgtctcaaaaaaaaaaaaaaaacaacagagttagttgtcaccattcttaattcctccttgggggatgagggaagagaatggggtaggagtggaagaagcctgattggggtgggagggtagggccaagaggtcctgaatatagtagctaactagttggactggactgaaaccagttcctagagttcatttcagccatccccctgcctctgctccccaattctgatatcttgaaaatctttaggtgcttcttaactctaaggatgtctactgaaagtctccctgaggtctaaccaagggaggctgtgtctttagagaatggagaggacaaggcaggtggatcacctgaggtcaggagtttgagaccagcatggccaacatggtgaaaccccgtctctactaaaaatacaaaaactagctggacatggtgatgcatgtctgtagttccagccactggggaggccgaggcaggagaatcgcctgggcccaggaggtggaggttgcggtgagctgagattgtgccactgcactccagcctgggggacagagtgagaccttgtctcaaaaaaaaaaaaaatagggaatggaaatggaagcaaggctctctaccctgcccattcctgcccagccttgccctcctgtgcctctgctaataccatctccaactactactgtgtgtgccaagggcatccctccccactgctcccatctgggggcctagtgattaggggttgggaaggatggggtgatgggtcaggggaccaggagtgtcccagaaggcagggaagcagagaggttagataagaccagctcggggcctctagtagtaggagttagaggaagacaaagagaaaacatgtcaaggcctaaatgcaccccccttcaccatcactctgtcatcaaagccagggggtgctggtgtctgatgagagtaaccaagaatagcaaaggctttgaccctgactcccaggaacaggcagcctagaggacttggaggggtgcagtaaaatgtgcttctggatcctccccacccccaccgcagatacacagtgtctaggaactacccaaagccaccccctgacacccccaggcacatagaccatggctgagggtctgggccagatggagactgatgctagggaaggaagagcagtactaggggactttgggttcacagagttggcctccatccttcatttatatccccttttctttccttgccctagcccctaagacttgcagccccaagcagtttgcctgcagagatcaaataacctgtatctcaaagggctggcggtgcgacggtgagagggactgcccagacggatctgacgaggcccctgagatttgtaagtaccttttctggattcttctccccaaacccttaacttatccctcttcctttggcagatgtttgggaggaggacagctgatccctagcctgatgtggaccttgctcagtgattgtatttgtccatgacacagctaaaactgtcctttacaccccttcaaaatgcttggcatggtgcctgttgggcttagaaatggcacctcagatttctccctcaagtgctgcaccccaagacagtgttctctgggctgacagctttgctagaagatggcccggcctccctttccttccagctcttcccttattccacctctcagcctccctgacccttgatgattggccccaggtcttgtcggatcctcagatcttcctctgtcctttggctcccaggccagaggccactggcacttgctcagccccataccagaagccccacccctgtgctcttcccgctacccccgccttcccctgcccccagtaagtggtgtaatcggaggcagctgttttaactgggagaaaggtccccgcccagcttttgccctgccaagggaagtggagaacttgttggtgggaccccagagtcctgggtagctggcacagtcctggtggctccacttttagcctctcccctgcttggttaatctgggccagggtcaaagcgcccctgcattcctaggtccgtctctgttctctctcttgggctttatcctgctccagtcccatctggtgtcctgtccccacacccccacccgtaattatcaggggtaattttagggctggaaagggagccactagtgggctctgcctcacccctacactctgccctggagggtgggggccaggggtattcagcaagtatatctacggcatggtgcttcagcctggagtctcttcttgtctggtgccacctgcacccccacacttttgaccctgatgcttgggcgttagaagtaaagaaagccatgcagaagggtcagatctgcctctttttgttcattcttccttcaatttgctgtaaacctcaccttatatgcattaccactctgttcacactcataccccccggactcataacatcacacacagacccacctggcactgatgagcccacctcccacccaaaggcacaaacacattctcacagtaacacagagtcacactcaaatgtggatgcagaaacacactctatactcagagagatgtccccagacacacataccaacatagagacacacacacacaaacccagattgattcacatggaaactcactgaggccagatacaccagcatacagaaagacacacagatacactctcactacctaccgctgcatgctatacagccacaccatcagttgtgtaagcagactcccatccaggcacacatgggtcatagacactgtcactcacacaccgtgtccaggcttgggggccaatagacagtggtctctctatctcatccatcctcttgagcaacaaaggaagttgcagagatgatatgaccagttggccacaacctttttttttttctttttttgaaaggtgggatctcactatgttgccttggctgatctcaaactcctgacctcaagtgatcctcctgacacagcttcccagagttctgggactataggcgtgagccaccatgcctggccagaccacaacctttgattcttcccaaatccttctatcaggcttgttgctgtggggttggaagtctagaatagtgctgtccaatagaaatgtattgcaagccacatgtgctattttgaaattttcgagtagccacttaaaaaaggtaaaaatgaacagatgaaatgaatttgaatattttatccaatggatccaaaatattatcactttagtacagtgtattcatataaaacctttagagatcttttgcatttttctgacattaagtcatcaaaatccagtgtacattttatacttacagtttgaacttgccgcctttcaagtgcttgatagccacatgtgactgggctacgtattgggcagtgaaggtctagaagatttggcaccactcttggccctgggttctgcaacctgggagctatgggaaggagtttttctttatcattggagtttctctgccatggaccctgcttccctcagctcatcaaaacctttttttttgtttgtttgttttgagacagatctcgctctgtcgcccacgctggagtgcagtggtgcaatctcagctcactgcaacttctgcctcctgggttcaagcgattctcctgcctcagcctcccgagtagctgggactacaggtgcatgccaccatgcctggctaattttttgcatttttagtagagacggggtttcaccatgttggccaggctcatcttgaactcctgacctcaagtgatctgcccgcctcagcctcccaaagtgctaggattataggtgtgagccatcactcccggcatcatcaaaaccttttactgacctcagtcgtcatcaaaaaccaggctgtcttcagcctgtctcctgagcatagaatgttgaggcactggggtccatgggaatggggcatttggagggtggactctactgaaggcctagtttctacctccacctgtttgcctacaggtgtgtggctactgtggggaatattgtaaaagagttccaggtggaagagtctaactagccccgaggcctcctgagatctgaaaccccagttttatctcccctcatccccagtgaacagctgaccagagagccaccatagccagcttgttcatgcccacccttctgtctgccctcaggtccacagagtaaggcccagcgatgccagccaaacgagcataactgcctgggtactgagctgtgtgttcccatgtcccgcctctgcaatggggtccaggactgcatggacggctcagatgaggggccccactgccgaggtaaggacttttccactctctactctcccgtctggatgcagcatattatcagcccaccttccgaggactgtcctggcaccttcagtggggatgaggccttgtcctggtcccctgcctagatttaccttcagagagcagatgaaattgatgtgccccttgggcctggagcttggtcagacagccctgtgggcctcagccgtgggctgtagcctgggcacttccctctggctatgtgttcttggactagtcactacctctctccaggtggcagtttttcttctgtaagatgagagatcagtgttttcatacttttttaaaaatagtatgatcctttcttcaaaaggttttctgcatgaaacctgagtgtgaacacagggaggagcagaggtgctgtgactaaagcttagccatctagtttagtccacctgccgcccctacgggtgccctagaaggcatcccccaggagctgcagatctttgaggggccctaaatctgccttggtccctccctctctgacagtctagactgtctgaggtggttgataggaaagccatccaggccgaggtgggaacattaggatgacaagtcagactgcttccagcctgtggctcaggtcaccagctctacagtctttcccccaaagggccctgtgggccatggagagtccggtcacagcgtgagcatttaagagtcgtgtccggggaggcagagcctcaagcctgcgtgttagggaatagtggcttctcccttctcttttcttcggggtctgggcccggagcaagaggccagctttgagaggccatgagcgtagccctaggggaggggctgtgcttgggtgtgggggcagtgtcctgtgctgtgtgcctgagaaaacatctgtctgtgggaggagactcatctggatcctgttcactaggagcagggaggatggagcaaaggagtttgtggaagatttttctccctttctttggttgattttgcatgttttcatctgaagctcctgggacgggatgcagaatgcgggcctgggggctgacttaaatgaccacgcgcaccccttcctctcgtgtggtgtgtgttcaagcttacttccttttgagtacctttacagtctctaaaacaacagagaacttcaaaaacctcaggtctgaatttccttctctgatattacagaaatcggcctcctcattccctcaccctatatccagaaaagttactcttttctaggttttccagagcaaatgatattttccccctctgtggagaaaggctgggcaggcagcatgaatggctctcgggtggaagtggggaggagaaagaatcgctggggcctggccccccatcccaactcttcctggcaggcttagtgcctctaaacgtcttagcatcttgggcggctctctctcctaggtgggggtggagtgggaagccagggtgtgaggccgctggacaaaggggtctttgtggccaggctgcctggccccacgcaaggccattaactgggtcgctggtctgggggggcaactgctctcccacctctcccccctcctgtctcattcccttctgtctcccctgtggaagtgggtcagtggcaggagaaagattagaaaagaatccagaggggaccagttttgctcctccttcctgtcctctacctgggccttaggccttctctctgaggcctctagggctccggggatgggttagacaggtgcttccaggccagagctgggatcctgtggggacagacacgattccatgcccacttttcagccccagctgaagccaacattgtaatccccaggcagtgtagatgagaggcatatcaaagggataagactcaccatcccctcttcctgttgaccccaacaaagtgccagaacccctctccatggggacagaggtagcccagaacatccagaacagagacatgtgggttctaagccatcactggctgtgtgaccttgggcttgtcttatagcctctctgggcttcagtttcttcacttgtgaaatatggtagatgcttcctaaggcccttctgtctctgacactgcagcccttagaagtggtttctgaaggttgactgggtttaggggaaggttgtggcctgcgtggagctgccagatctggcggcctgaatatgtgtctctcctgcccccacacagagctccaaggcaactgctctcgcctgggctgccagcaccattgtgtccccacactcgatgggcccacctgctactgcaacagcagctttcagcttcaggcagatggcaagacctgcaaaggtatgtgagtgcatgtgcctgtgtgcatgtgtgtgtgccagtagccagttgaggtgggcagggaggggcagagaggggtagggggcctggctggaataagaaactagaaggaaggtgcaagagagggggtgccaccaccccagggcatgactgtgagccctaaccatttgcttccactagacttctaaaaattcaccttaaaattatagtttatatgtaaatttttctgttgtaaaaaattagagcattaacagataaaaccaaagtcccctttgacaaatccccctcaattccggtccccttcccatctccctggagttcaactctattatcagtttgctctctctctttcaggcccttttttgtgcatttgtctctgggtattcacagaaaatctaattggaagtactgctcaagagtactgcgtgctcttttttacataaacaatagtatactgtgtatattattttcaatgtttttcactcatcagtatgttccacaatttttttttctgtgttaatatgtaaagatctacatcattcttttagaaaccactatgacgtatgacttttaccacagtttacttggtcacctccctgttgatgagtgagatgttcccaatttttcactgctacaagcaatgcaaacttttctgttttaaatttgcctccctcgggtctttgtgcaaatgccaccttctcagtgaagccgtcccccgacccctctaaaactgcatccctgccatctgcattctctatccctgttctcttttcattgcactagcacctctaatgtatactttatttactttgtttcatatgttattatagtaactatatttcatttattatctgaatataagtttcatgaggacagcaatgtgggtctattttaaagttcactgatgcacccctggcacctgacccatagtagggactcaataaatcttccctgcgtggatgagtgatatgtacacgagtgtttctctagagtggattccaagactggacttgctgggtgttaaggtttgcacatttcatgctgtaatagattctgccgaactgtccttcaaggtagctgtaaggatggacatgttgatcatgtctgatgatcacccacttcgttgcccttgtcacactggaaatgaccacattcttgccctttcctcggcagattttgatgagtgctcagtgtacggcacctgcagccagctatgcaccaacacagacggctccttcatatgtggctgtgttgaaggatacctcctgcagccggataaccgctcctgcaaggccaagaacggtgggtggggttgcctctggccacagtgctaactaagccccctcaatgctgttccctggtgggtggtggcctgagaggtggtcctagagccctggctgcacggactcttctcttccccattcccagagccagtagaccggccccctgtgctgttgatagccaactcccagaacatcttggccacgtacctgagtggggcccaggtgtctaccatcacacctacgagcacgcggcagaccacagccatggacttcagctatgccaacgagaccgtatgctgggtgcatgttggggacagtgctgctcagacgcagctcaagtgtgcccgcatgcctggcctaaagggcttcgtggatgagcacaccatcaacatctccctcagtctgcaccgtgagtcacctgctctcagcttggagggctggggagggtaggggagacagggaaggtggaccctatcttgaacagaggccgggagttacacaggatggtcctgtctggggcaggagaagcaggaggctggatacaatggtgtgtgtttgaggcaggggcagagccaccggcacgctccctcccagctctctgagcaagtgtctggatggcccctgcatttctggccaagggctgagggggcagtgaatggtcaatctccagagaccagggactgtcccttctctgagaggggagtgttgactagactgcagagggactttccggtgcagtgggagccaaggctagggaaagaaggagcggaagcctgaggtgccctgttaggctgcagctgagggtaaaggagctggggcccagctgctctgtctccatgggccatcgtttccctcggggaccattgccaatggactctctgctgccatcgggggagggcagtactgaggttatttctctgtggctttgtggcagtgaatgaggctgggagaggagcgtgagccacatgagattttagaatatcctggatgcttccattcaggcttctccctaggctacacttttgctatcctagttgtggaagaaggggtgtcacagaaaggggcacgagcatagctgggtgtagacccactgccgggaacagccctgcccatctcagaggctgttacaccagcaaccttaaaagtcaacatctggcagcatcacatttccaaagaaatgcaccacagggctgagaggaagaatctggcctgtggttgatctgaccccctaagggagattaacttgatctgtaactgtttagtaaaccagaattcccatctctgccttggtttcctaatctgcataatgggtttgagcttgtctgtctagatcagattaactggagtgaaagccagtggtaaaggacagcacactttgaagttgaggattgtgaaccttgggcctctctagaagatcttcaagtttctttatttggttcttgtgatgaaaagaaagatcccaggaggttacaagggattcattctgggagagagaaaggcccctccccgggatggtggcgagcaggggttcctctgagagccctcactctccgtggcctcagcgtaaggttcacatttctgcctttggctcctccagagcatccctgatagcgtccttgggctgctgctgtccacagctcacctgtgatcagacatgtgtcctccttggggtgctgagctgggggctgtcaagcctggttggctgagctcttaacgagtgggcgactcagggaaccccatggctgatggggtgggattggtgctagaccctcttgtgcagctgccctccccctgttccttgtccactgacctactcaacaggcctgtctgggcagacagcttgtcagtttcctccccagccctgcatcttgccatacagtgggcttctgggtaggtggctatggggtgtcctggaggtaaccttctcaacttctactctggcctcatctccttatctgacttcctccccaggagaagctggtacccctcccttggcaaacagatttgccttgcctcccagtctgctaaactcactgggcctctcaggggcagagtccaggaggctagaagagtccaaggggaaatgcttgtggggtaaatgagtgggtttctctcatcccagcttctgtcccttcctccctgccctccccctgctccacgtccctgccgcctgaatgtctggctgtcaccctgaggatggttgttttgctctctcccacaaactaattatgggtcccaaactgaggacgtcagtgtctctcccctagcccctcccccagtttctgggtcatccccctccccaggagatgctgactggcctgccctggtgtgtagggtggctggtcccaggcactcacctgcacagtggctgctggcctgtaattagctccccaaggaggacgaagaagaaaggctgcagctttcccctgctttcactctgccctccagggcagccctccctgcaagccttccattctgtgctgtgactgtgacctctgttggacccctggggctgagcctcatgcagcaggggtgcacacagagggaggagtctgacaattgaggggtgttcgagccagcgaggccagcccgctggtgcaggcagaagggggagcctgccccagagaaaactctggaagcagaaatagaatagaaagaaggaaggaggccaggaaatgagcctggttcacatgtgtcctgggccatgtgagtcagacctgttgtggagtcctgagagcccccgagggcccccctgaggccctgcagtgtgtgaacattcctcttcaatgccccagggctgctgaccctcctgcctcaggcccagtgttatccccctggattgggtgggtcatctcttttcctcccacctgagattacctccccctcccctctgccgctggcccagtggtttggggaggtctatgaggctcgaattccaagaccagagaactccatggtgagagccggaagagaaggcaagacccttggccagtaccaagagcagccctggctttcactactgctttctcaaaggggctatgcattgatttgattttagatggtacctggacaagctttttttttttttttttaactgttatagttacgtttttatttgatatgcattaggaaactcctgtaactagcacatcaaatctgttacttcagcaattgtttagcatgcagcgaaataagaaaagtaagttaattgaaataactggtaataaacagtagcgcaagctgtacataagcatggtagacattttgaaagtgatacacaaaagactaaagttctgaaaattgaggcccagagggatcaacaggcctgatagtcccttagtcaggaaccaggcctgcgcactctcacccccacctctgaccagtctctcagctccagaggcctatggagcctgtaacccagctttgtccagcctcctgccaggctgcccctgggcaggcctggtggtgcagtctaccgaccccagcccagccctgcatttcctaagctgagctcctctgatctgtattcccttcaccttggaggatgccaccactgtagaaagaatgaggcagactgcaagattggggtcctgggaacatgggtgtgtatggtgaggggaggttctgaggttgtaaatagaggccttgaaggaaatcgggtttgctgaagtcactcaggagtttggactgtgtgtgaaaggatggtctgaaggggctctcagaggtctcagggttcccctccctgcaccatgctgcatggggaagaaggaggtggctggggagctcagcaaagggcccctaggctgcaggcagcaaggttgcgaaatgggtcccaggtccagctggccaacttcacttttcccttcctctccctttcttttatttatttatttttttagtgtgtgtgttttcgaaatcacaacaggaaatggggtagtgatttgtctagaggggaggcaaagaaggggcagacagcagtccctctgagtctaatgaactggctgctgctgctggaaggggtgctacctccccactgtgctgggcacccctggaccctctcagcctcccaccctgcctacaaagcacttccagacttcacatgtgaaagctaaccatgcccatccttggcctttctgacccatgggatgccaggctgtttggggaggggtggctctagccaccccactctttggccttaggccccctgcatcctggcacttttgcttcccattcctgttctgagtttcctaatcatttaacagctcactcttgctcctcctctctcctggcccgggccagccctgtgtctcccggcccagatccagccctgtcctctcctcccccgctgtctccttgaaattgcctctccacccagactgctcccagcactccccttgctgttttcaagccaaaggaagtaacttaagcaagagagatgtgttttagagcccggcaaggatttctcaatagagggaagaccctaagatgggctgagtggaatccaggcatcatccctgggatctaggtcgaaatgcctcttggggacctaagccaggcaggggaaggtagcaggacataaccacaggctggaatcacaggcaggagcaggaagagagcccaggagaacgaggtgacacaacacggctaagctccagactggctggtggaaggaagagctgaagtcgggacccagcaggaaacaaggagcatgaggccacatcgtttagcagagcttctgccaggctcgccaggaggtctccttcccaccttcgaagtcctcagactctccgccatctctcccaggcccaggcgagatccctgagtaggattactagacagactgtcctctcccactgtcttggagtgtcccaaggccagagaggcaggatcctggcagtagaagagagggggaaaatgatgtcccagctctagaacaacagactcagtcttcaataaatatttgttcaatggatcaatacatgtgtgtcagacgcctgagacaaagacaaaaggcagcgctctccttacagtatttgcagtcaggtgaagaggccatgatcaaagaagctccagaggcctatggagcctgtaacaggaaaacttccttcttttttttttttttttttttgagatggagtctcactctgtcgcccaggctggagtgcagtgatgcaatcttggctcactgcaagctctgcctcccgggttcacgccattcttctgcctcaggctcccgagtagctaggactacaggtgcccgccaccacgcctggctaattttttgtgtttttagtagagacagagttttaccatgttagccaggatggtctcgatctcctggcctcatgatccacctgcttcagcctcccagagtgctgggattacaggcgtgagccactgagcctggccttgaaaacttccttctaatagggcaagcttccttctgggagcctgagccgagtcttgacgagtagtaggtgttagccccaaatggcccacctggagggcccacctagagtcaggaggccacagggctctggctggaggcacagagggcgacttggtggaaaaggtgggaaaggatgggttcagggaggggaggacatggtgggaaccgcagcccccatgtggggagtgtttatcatgcaccaggcctcatgctaagtgcagttagtgtaccatccagttttacaaatgaggaaacagagactcagaggcattaagtaacttgctcatagcctcagttggaaggtgacagaaccagaattcaaactcaggctgtcagtgtctagggcccagttggacccagggcagagcagaatgatatgaggagaggtggggaggttcctggaacaagggccagaatctagtgtgctccctggggatgtggatagaggtccagggacctctttggatgtgtatacactcttgggtgtgtagatgtgttgggtgacattttctcaggacataaaggcttcttccttccttccgatttccttattttagagcaggtgactagaatcctgcagctgaagctagagtctttttgggcatggggtgggtcccatgtgtttgggaaagcagccaccatgtatggaaatgcctcttgaacaatgggaatgatggagaagttgagaaaagctggagttgtagtgagtgcagatgctgagcagtgggatggggtgccaggacaccaggtctattctggggcctggaactgaaagtcctctgtgccataatgggcagctgtggtctctcgtctgactcctgcacctcttccctgcttcctagcctccctcttcatgctggaatcccctgcccctctgcccctagaccacccccaactccttccacaacacagcctccctctctcccctttggtttatttgagattctcctgtcctcaggattttcggcctttggccagagcctcttcagaaggtgcgctcaggtggttggcccttagaaggctgggcgacaaggggacggctcccctcagggttggtggagccagaatgctcaggatctctgggctgaagcccaggactccacctggaccccaattcataagacagagaggggtggcccagatactgcctatagggcagccctggaggcaaggttcctcctctccctttgagcccatctctctacactggccttggagtggtggccaagtgtatgtgtgtgtgtgtgattgtgcgtgcatttgtgtgtgcatacgtgcgtatgtgcgtgtgtgtgtggtggggcaggcagaggaatctgaactttaggagagagaaaaataatgtggtgcagggggttggataacaaaggatttttgcttgcaactaatagtctccagctgcaaaaataccaaaggggaggccaggcaggccgaggactccagttcttgccaactcctcaccggcctgctgagtggggccctgcctggcctttggggaggtggaagggagaccggccaagggtaaatatctgagagcagggatgatctctctgccttccttcccggaattgggagggaatccaggccacatcctgaggctgggggggctgattgtggagctgcacctgggatagcggcatcagatctctgcaggtttcttccttctctctcttgccaagagaagggtggatagggggagcaggggcagggtattgccagccctagggctgggcagtgactcagggaagcctcaggaagtcggagagaaggccggccgtagctgcgccagctggtgctgggaaaacagctttcactgatgaagttcatacacatgccagcagcccccagacccctgccgtgcccaccaagtaaagggcacgcagccctgtttgacttccagccaccctgctggctgccaggggatgcaggcaggtccctgctttgagacttcgatttcctttggaggcagcccagcagcattcatttgaatctgttttctctgtggttacagcgtgtggggcaaagaatttggttgccttacccctgcactaggccctcttcctacagggccttggcctcctcaagctactcttccccctctctccaatcttgtgaggatgggacagtactgggggcccagaggaaagagtggctgggcttggggatgcatgaatacttacgggggtaatacctcgtctctgtggccttgttctccaggcattgggatgggatttagcagagaggacctgaagaagaaactagtttgatgaagccctcagttggctccttcccttcctgtcctgtgactctgagtcagtgtcagggcccagccaagttccttgagagcggcgttcctgttctttttgcccccaccccaccctcacccactgttagggagcagcccctgaatccctgtggggaggagggggaattagggaggggtcaagcagaacagcaagtcattatacctgtagctgtgtgggggcagaagaatccctactgggttgagtatgggtaatggaggatgagtttcagcccaaagcaggtagcccaaagatttctttacttgttggggaaactgttggagatggagttccaggcaggggtcccagaaagtcactgccttaggagtttcccagtttgcaagaggcaccatctctgatggtggtagttgaagggggtagtgagtagatggaaggaagccagtggtcctggagaggaggagcccagaggaggccagcatgtgtccctgtccccagacttcctgcctccttgacttccggccacccttgccctgcctctctttcctttggctcttcttggcttcttccatctcctccagaaccatgcctgaaactgagtctaggcagctgggctccatctccttcccccactcccatcatccttaagccccatctctttctgagccatgcctcagtttgccctgaggattctttcatggccctcctcctagactctctctcctccagccctatgacttattccccacctcttctgaccctccccaggacatgaggacattgagcaataaggacattgcaggaacaggggactggggctgagtagaggaagtttggcccatgtcactggtgcccaaccttttgcccccatggatcttccctttggcatctctgtagagttcatattttgaaatacttttctcccaaactgggtttattagcgtgtaccctgcttttccactttaaaaatttatgccatatgtccagcttccagtcagtgcttctggttagcatgagataactagatttactgtagatggtagataaaagtccagtgaaaagcaaagatgtgtaatgttttggtagcctcagtgctcttatcccaagtaaaagcaaagttaaaaaaaaaaaaaaactggactgagctagtggacctgtgctctctaccttttggtgccccaagaagatggtcccttttcaaggatgggctagaattgggaagtctgtcagtcaaccagccagccagcatttacgcaagccctcctgtatatccactctgagctaagcatgggggtgttgggtgggagggcgtccagagaaggtgggcttccaggtgtgggttctcaccagcaaagggtgggcatctctgcaagagggcctaccccaccccatggctctttcattcgtactctccagacgtggaacagatggccatcgactggctgacaggcaacttctactttgtggatgacatcgatgataggatctttgtctgcaacagaaatggggacacatgtgtcacattgctagacctggaactctacaaccccaagggcattgccctggaccctgccatggggtgagagtggcaggcggggttctggccctggaaggtgggaggctgaggctacagtggtaaggagggtgcccaatgtccagaccccatttaacatgcatcttcccacaggaaggtgtttttcactgactatgggcagatcccaaaggtggaacgctgtgacatggatgggcagaaccgcaccaagctcgtcgacagcaagattgtgtttcctcatggcatcacgctggacctggtcagccgccttgtctactgggcagatgcctatctggactatattgaagtggtggactatgagggcaagggccgccagaccatcatccagggcatcctggtgagggagctactgtctgaggttttgtgggggaaccatgatccagggccttctggtgaggggggaagcctctgtaggggaaccgttctctgagtctcctggtaaagagcgtggatgccccaggcctctagtgggagtggggtgggcttgaatactgcagagaaaggacaagatacgggttccactgtgatgggaacagtcattttagaaacaccacttctgtttacttcctgtttctcatttgacccttataataacccctagctgatgaacagggaggtggttcagttccctttcagcagatgaaaaagcaggatcaaagaggttaggtgatttgcctgtgtttacaaagccgggtgatagcactggaacttgttctagaagccttgctggctcagaggtggcatctccattgtgggataattagtgtgagcaaccagcccagtttgcctaggactgtcccagttttagccctgaaagtctggtaagccagcaaacccttacctttgtcttaggcaaactaggacagttggccaccgcagataagctatgtgggtagtcaggggtgttacaggacttgcttggggcaagtgtgtcctcttagccctcataacagactaagaatgtcctctgtggacagagtttagagcccatctctaattcagtctaaaatcactaaagtgtctaacgagtgcctaattctgtgaaggacagggtttctgccctcaaggggtctgagtagagtgggtgagataagtccacaaatcactgtgccagacacggatagatagcagtgtcacggaggatgtatagaaggagaaaacatctctggttagaagattccataaattctttaaagacatgctctgtagaggatgagtgggatcttggtaagcaaaaatcttcagaataggttagtccagccagaggagacaggagtaaagcattgagttaaaaaatggtggggccaggcacggtagcccacacctgtaatcccagcactttgggaggctgaggcaggagaagtgcttgagcctcggaggtcgagaccagcctgagcaacatagggaaaccccatctctacacaaaatttgttttaattagccaggtgtggtggtatgttcctgtagtcccaactactcaggaggctgaagcaggagggccgcttaagcccaggaggtggagactgcagtgagccgtgatcgtgccattgcacttcagcctgggtgacagagtgaggtcccgtctcaaaataaataaataaaaattaaaaactacaggatgaattggggaatgcaggtcatgaagtctggaggaagctgaggggatctccaggacagagggaggaacccctgtcatctcatgctgtccattcttgcctgcccgtctcagattgagcacctgtacggcctgactgtgtttgagaattatctctatgccaccaactcggacaatgccaatgcccagcagaagacgagtgtgatccgtgtgaaccgctttaacagcaccgagtaccaggttgtcacccgggtggacaagggtggtgccctccacatctaccaccagaggcgtcagccccgaggtgagcagggctccatggcccctccaaagctggctttaccccatgatggctctgggaccttgggatcacagcccctctctgggccctcctgtggggaccctggcttctttcatgtcatgaccgattctcctagccagccactcgggctacctgccctggcccctcagcttcccctgccagcccccatccacccactcagcctccagatcccactctgtccctcccattccccttgccagtctggagcagtagcacctggccatgggcaaccctggaactctcttccctgactactgaagcccccactccaagagtttgaaggctgggttgttggggggcagagggtttccacccctgtggcttccaaatcctaaaatgggatagcaagcacaaagaccacagcagcagggggtgtggtcagattcaggaagccttctcaaggcctggcacaggggctctgaggggtcctaacagctcttcaccctgcccccagtgaggagccatgcctgtgaaaacgaccagtatgggaagccgggtggctgctctgacatctgcctgctggccaacagccacaaggcgcggacctgccgctgccgttccggcttcagcctgggcagtgacgggaagtcatgcaagagtgagtgacagggaagggggtgtgtgcccattgggaggctgcgggagggttcctcaggtgtcccccacagcccggctgcctctgtctgacatgcagggagatgaaggaagtgtcccagagtgtacctgctagtgagggcagagatgggacttgaatccatattcgaaaaaagtgcttttctcactcacccaccggactctgcagaaaactaaactgattcattcagcaagtgtctagtgagcagtgagcactcactacatgtttggcactgttctggtcatcaggattaagcagcgaacgagatagatgttgtccctggcctcatggagcttatagtctagttggggaaacaaataaatgtaactttaggtggtaataagtggttatgaagaaaataaaacagagaatagtcaggcgtggtggcttatgcctgtaatctcagcactttgggaggccgaggcaggcagatcacttgaggtgaggcgttccacaccaggctggccaacatggtgaaaccccgtctctactgaaaatacaaaaattagctgggtgtgatggtgcgtgcctataatcccagctattggggaggctgagacaggagaatcacttgaacctgggaggtggaggttgcagtgagctgagatggcgctaccacactccagcctggatgacagagcgagacttcatctcaaaaaattaaaaataaatgaataaataaagcagagaatagagttaatgaggagagcaagggcctctctgaggatgtggtgtttgagccaagctctctgtgaaatgaagagggcaaccatgtaactccctgagggaggagcatgtccggcagaggaaatcaacagtgcaaaggccctgaggccagtgtgagtgtggcaagccagaggaacagcacgaaggccagcggggctgagtggtgtgagggcagagaaggaggcaggggttggattttattatatctgggataggaagctcatagtgacttttgagaatggaagtgacatgattggattcacatttgtataaaagtcacgctgctactgggtgggggatgggcagtagggaagtagccagaagactttcagtgtagtgggcaagaagtgatgtggtttacactaggatggcagcagaggaagtggtaaacagtgatgtgactccaacatattttgaaggtactccttttataccactgatttcatgactgatcagtgggcacttagctgaaaacctgctattcttccctcatttcctacccttggagtgcagaggtcagaccccagggtattgcggccaggacccatcgtcctgtatgttagcgtgtgcgtggtctgtccatctgacccagagcctcgcatccctaacgtctcctgacccatcacagctagggcattgcagccccttggccgcagcccctgggtggggatgatggtcatgtgtgtgtctgactgtaccctggcttgtgcctgctctagagccggagcatgagctgttcctcgtgtatggcaagggccggccaggcatcatccggggcatggatatgggggccaaggtcccggatgagcacatgatccccattgaaaacctcatgaacccccgagccctggacttccacgctgagaccggcttcatctactttgccgacaccaccagctacctcattggccgccagaagattgatggcactgagcgggagaccatcctgaaggacggtatgggctcctagggatgtggcccatggggatggaagggggctggggcccaggcatctgtttctcggtgccctctcagcaggatggtcccctgctgactggctggctgcactggttggcatggagatgaggggatagacagattgacccctgtgtgacccccttcttggctgagccaaagaggcagggttaggatgggttaggcagcatgggccgtccttgccagcccttgggaaaactcagggtctgtctgcattggcttagagccctggagctgcacacagcacacagccaggggacaactgaggtcttgaattggagacaggcctgccagatcaaaacagggcacacccacatgtatgtgcgcacacagggtctgtgcagctgaccttgcagtcgccaaaaactgcatgctaatgtgtcctgagaaaattgtgttttgtgagttgcatccaggtcttccctctgagctgcttgggcaggttcacagtgcattgtctttttaatgtctatgtgaaggattctgagctgtacgagttctgccccaaatctgcacttgggcctcaggatcaggccgcctccccatcaatctggtggatgccagttataacctttgccctgcaccccatccacactgtagttcagagaaaatcaacagtcagcaatcatatcacaagactttggggaaatcaaaagtaactcatcaggaaaagattaggggtccctataccaagggaactgctatttaaaggacacttggagtgaaggctttggctaagtgaaaaatcacttcctaatttattcattttgttagttcaggatttttaggcctaggatatgatgtcacacttgtgcccagagccacatgcccgttgtttcagctctccatgcaggcacgggccagatgccctcacacgagagcccacatcagccatgtagtttaccatctgccacgtgtggttttgagaggctagccctgatacaaatggcagcacacagggctttcccctattccttttccagcctcctgtccctacccccacccatctgtctagggccccagagggtccctgcacccctctgtagcccagactgctcaaaggtacctgagtccgggagggccagaggcaggcagctttgaacttcctttgaagctgttcatcactggtccctcttcccccaacaggcatccacaatgtggagggtgtggccgtggactggatgggagacaatctgtactggacggacgatgggcccaaaaagacaatcagcgtggccaggctggagaaagctgctcagacccgcaagactttaatcgagggcaaaatgacacaccccagggctattgtggtggatccactcaatgggtgagtcctcccaggccttggggtgggaggagctgggagtgtgtgggcctcagataactggaggatgaaatggacagggaagcaggggaaggcaggtgaggcgggatactttagcaggaatgagagtctgcaaggggagaaggagtccctgtcttcagggaaatgggagtgattccttaaacatagaagaaatctgatcctgtcactcccagttcagggccttccaccagctccccttaccctgagaatgaggcccacgttcttgtcaggcctgcacagccccacagtgtctgcctggcccttgtctgacctcatctgcatcccgcttcccacacttgaagttctgtccccactgcctgctgtctgtttctcaaacaagcaccccggctcctcctgcctcagggcttttgctcttggagttcctcagcctggaactcccagatatttgccggactggcttcttctctacatcaagtctcactcatgccacctcctcatggtggccttctccatcactcccctgacacccccacctgcagcccggtcactctccaccccatcaccctgctttatttccctcctggcctttatcgctctccatgtaaccttgattgacctgtttcttgtgggatgggagctccgtgggagcagggaccttggctgccttggtctccactgcatccatgaatgccaaaactgtgcccaacttacaggcactcaacaaatatttgttgaatggagtgaatgaatgaaatgtgtggtccagtgatgagcaggacaggagacccctgtgaggagctctgggacagcactcatggattgggatcacaggggaggctgttgatggcgggggtgcccaggtgatgctgaccagtcgctgcccacaggtggatgtactggacagactgggaggaggaccccaaggacagtcggcgtgggcggctggagagggcgtggatggatggctcacaccgagacatctttgtcacctccaagacagtgctttggcccaatgggctaagcctggacatcccggctgggcgcctctactgggtggatgccttctacgaccgcatcgagacgatactgctcaatggcacagaccggaaggtgggcaggcatgtgcctgtgtgggggaatctgtgtgtgttgctagaccatgcttgggcgtggatgaggttctgtgtgagtatgtgggtatctgtgtgtgtccaggcctgtgtgcctctatagatgtgtgcatctatttttctgtgcatctatagatgtgtacatctgtgagcttgcatgtcttatgtattgtgttgtttgtttgaggattgcctccatttgcgtctctttgtgtctattcgtgttgtctgtgaagttgactgtccatgtgccagtctctgcatacacaccatgtgcgcctcctcatgtgtgtgcatagatacacggcatgccttggtgtgtgtctgcactctctgcaagtgtgagggcctagggacggcatatctctacacttggtcatttgggttgtcatgtgcttcacgagtcatgtacgtgttctagtatataaggcccttcatgatatggcccctgaccccctctctggtctcttttctccccacttccttcatcccaacactctttgaacaagcagcactagacagcttgctcctcccagcacacgtcacagagcatctgccctctgtgccattactcatgcagttcattccacatggaatgttcaccccagctcctcttcccctggcagactgctcaggggctacctcccctaggatgtcatctccagacccctcttcacactggatcacccgtatgtgccctatctgagacagtgggaagctcaagggcagagatcgtgtcgttttcacctcttactacctactacagctcagcccctaacagatcctggtaaatgttgaagaaatgaatggatgaatactgcccgtctgctcattagtgtgtgtgtgtgcgcgcacgcatatgagtgtgtgtgtgtgtgtgtgcacgtatgtgtgcgtgtgtgtgtttggggactatgaatgaataggaatgagcccaggagaggaccatatggacaacctcaccatcagcatccttgctggatcactcgatcacccgctggcttcaggatctaccatcccactgtgtgcaaaactatcactctctggggctcccaggctaatgggggaaacaaagcaaaacccatgcccaggacatagacaaatgaatgtacaaaacagtgatctcacaggcctccctcaattttcttccaactccttagtaacatcctctccatccctagattgtgtatgaaggtcctgagctgaaccacgcctttggcctgtgtcaccatggcaactacctcttctggactgagtatcggagtggcagtgtctaccgcttggaacggggtgtaggaggcgcaccccccactgtgacccttctgcgcagtgagcggccccccatctttgagatccgaatgtatgatgcccagcagcagcaaggtacctccttggggctgggggcagcgtgggacctggaaggggtggtgggacttaggcattgatttgagacttccctgggagtgaaggcacttcccagggatcctaggctctgacttttgaggatcctgagaagagaactcccccaacacaatctgattctctgttccccatttcccttcctgccccatgtctgtgtctcctgttcttcaacatgatcttcttcctctccatatttcctctttctgtccccacatcttaatgtgtctcctcccctatcccttctctgacctctcctcacctcttcctccctttgcctttccccatggcccttccccacagttggcaccaacaaatgccgggtgaacaatggcggctgcagcagcctgtgcttggccacccctgggagccgccagtgcgcctgtgctgaggaccaggtgttggacgcagacggcgtcacttgcttgggtatgaggtgcctggctgggtgggagtgggaagcagaccccatcaggaggatgccgaagagtggggaggggaggatccagggtcccagtcagagattaaggaggcaatgaggggcccttagggggccaacaggaagcaagggagggggagagcaaaggctctgggggctaggagggagtttagggaagatgggaggctgggagggacttgtgaggggatggcaattaggggaaactgagtgaagaatggacagctatggatggaaggaggaaattatccttcacttcttttaaatgtatttctccattactaaagtaaaataataaatagttccaaatattggaaattactttgggaggccaaggcaggctgatcacttgaggtcaagagtttaagaccagcctggtcaacaaggcaaaaccccatctctactaaaaatacaaaaattagccaagcgtggtggcaggtgcctgtaatcctagctactcgggaggctgaggcaggagaatcacttgaagcccggaggcaaaggttgcagtgggccgaaatcatgccactgcactccagcctaggcgacagatggagactctgtctcaaaaaaaaaaaaaattaacattaaaaaatacatataatatatatgttggaaattagagaggagaaaaaagcccaaatcccaccagtgagcaccatatattgttagcattgtggtaaagtgaacaccattcttttttcctcaggggggttataattgttttttacatagctgtaatcatctgtttataaaatgtcttctgcccttttcggttcaagtgtcacagcattttctgtgttgttattgcatgattttaacaagccttgttttttattcaaaatgggttgtgttcattgtaaaacggagtaagtaaggccgggcacagtggctcacacctgtaatcccagcactttgggagcccaaggcgggtgaatcacttgaggtcaggagttcgagaccagcctggccaacatggtgaaaccccgtttctactaaaaacacaaaaattagccaggcatggtgtcacacgcctgtagtcccagctatttgggaggctgaggcaggagaatcgcttgaacctgggaagcggaggttgcagtgagccgagattgtgccactgcactccagcctggcgacagagcaagacatcatctcaaaaagcaaaacaaaacaatgaaataagtaaacagtatagaaaaacacaaaggagaaagcccaaatcatcccagattccaccacctgtagataaccactgttaccatttgggggaaccacctcccaaatgtttccctatgatttactttcacataaatggagtcgtgctgcacatactgttctgtttcctgcttttgtcacttgacagtatgtaacgagtacataagcagcatttttaatggctaaaatatatttcatttgataaatttcacgtaatttactcaaccgtttctctactgttggatgtttaggttgtttccagttttttgatataatcacaacccatgtttgttgagcatggactgtgtgctcagcactgtcatggacatttcccttgcagtaatttgtttacccctaaaaacatcctggtgggaaaagtggttttattatccccattttacagatgaaaaaactgaggcccaaagttagagcaggatttaaacccatgaagtttgacccagagcctgttttgtaatcatgcctctgctatttgtcacatcatcatgcctgcccatattctggatggtttccttaggatagaatcccggaagtgaaaatgggtcagtgcagccatagtgtacacctaggagggagtggctggggtcaggagagggcgttggctgagagggttaaggaatggaggggccaaggtaatgggaggatcatccacatggaagttgaagtcaccaagaactgaaccaggagtgattttggagaaagtgctggtgagccaggagctaaaaacccttacagatgacagggtgcagcctgggagccttccagaagtagaggttggtacagaagcatgatgtaaggggaagaacagtccagggaacagcagtgaggagcaaggaggacacataccagcctccaggtccatggtccatgggatacgggaggggaaatcgccacccatggggccatgggaagtttcagagattagagaggggtgggagatgagtcagaccaggcaagcgcccagctgtgaggtctggagaccgggctcacacaggagcctgcacttgtggaggttaccaaggcacagacaaaggacgtcgtgatttagctgctaatgggccaagacagatagtgatggtgaggcatacgttctggggacaggatgggtggagcctgcgcggatgtggtgccatcttcacttctgctggtgggaccgatgaaactgtgaaataaaaagtccagggaccggggcagggccctggggttcccggagatgacttccaaggggaagttcatggagaagtcagggaaggagtggggagagcctgttcggtggtgacagaggtatagaggccatgggctctcttggacaccatttgattctcaggtcacactgaagtacagtaagcattaagtagagtaaacatcactattgttgcttgggaaagaattgcagtttccatccagataatttgtttcatgaggaattttgtactagaaaaaattactttgtattattaaaaaatagtaaaacaaacaaaaatggtgcaaagggcttagtacttgtcccacgaccggggtctgactttccccctcacgatcctgtggtgcccacagcgaacccatcctacgtgcctccaccccagtgccagccaggcgagtttgcctgtgccaacagccgctgcatccaggagcgctggaagtgtgacggagacaacgattgcctggacaacagtgatgaggccccagccctctgccgtgagtcacacgccctgccccaccctgttggatggcaggcctgcagggcagctcggctctggcagtgcctatactggagcgggcaggaagctgggggcacccaacttctcgctgacccctgactcattccctccccagatcagcacacctgcccctcggaccgattcaagtgcgagaacaaccggtgcatccccaaccgctggctctgcgacggggacaatgactgtgggaacagtgaagatgagtccaatgccacttgttcaggtgtggagcggggctcagatcacacgaggcacccctcagtcaaggaggcaggggagacgagggggccaggttcagtggctcatgcctataatctcagcactttgggaggccaaggtgagaggatcacttgagcccaggagctcaagaccagcctggccaacatagtgagacctcccactctttacaaaaaaaatttaaaaaaactgccgggcgtggtggcgtgcacctctagtcccagctacttgagaggctgaggtgggaggatcacttgagcctgggaggttgaggctgcagtgagccatggtcatgccactgctctccagcctagacaacagagcgagacctgtctctaaaaataaaatgaaaggagcaaaagaatttagggcagaggggatggagccctgagcaggagtggggtctgctatccccttcccagcctgggaaactgagagggctgagcttgcaggggacagagcatagctctagactggagaggaggaacaaggcagggtagatctcctcctgggaggataccagagaccccttgagagaaagagtaaagcatccagtgagaccagagagatggttttgaattctctaagagaaatggttttggatccttggaaataagggacaccaaaggcagagaataatagggaagaagaggcagtgaagagagggtcaggacaatgagtactcacacccatccctgccccccagcccgcacctgcccccccaaccagttctcctgtgccagtggccgctgcatccccatctcctggacgtgtgatctggatgacgactgtggggaccgctctgatgagtctgcttcgtgtggtaagagggatgggcagagggagtcaggctgggcctgggggaggggcatcctgagagcatgccagttgggggtgccggagacacctgcaacccagcacttgggtggccttgagtgagttaatctcggtggcctctgtgagaggagagccccatcatcacagcattgtgtctcagcaaactcatgcaggaaaagcactcagcacaggtcctgtgtctgctgactcatggggatgagtgagtggagtttccagccgaggcactgctgcggggccttccccacccttcctgactgggctaagggctgctggttatgggagggccgctgcactcacctgcccagtactgtgatgctgtgtaatcgtgaaggccctactcagctactctttcttcctcacagcctatcccacctgcttccccctgactcagtttacctgcaacaatggcagatgtatcaacatcaactggagatgcgacaatggtaagagcttgctctcctcacctgctgattcctaagacagctagaggctacagccaggccctccagggaaggcaaagggcttcagaatccagcagggcctccctccaggacactgaatccctgctgggttgcctgggagaaaacaggagaagtcagaaatgcctggagggagccacgatggaccaaggggagaccatcaccttttagtgtcattcctaccccaggcagggcctgagctgcccaccctctagtagggctcggaggccagggagagatgagtgagatgggccagagaggcagagcaaggagaaaccggtgcctgactcctttctccttgcaaacccccatttcctggagtccttggtgcacccctcaggctctgggcttcaggctcagaagcccacctggcagatagccatggaccaggtgatgtcagccttgagccaccagggctagtatgtgtgtaaatgtgcgggcaggtgactgccgtgtgtggtgtctcagggctctgttctgtctgtgttgtgttgtgacgtgctgccccagtggttcctgtcccagctgatgtgtgagcggatgtgttgggtcagtgccacgttgcccctcactttttctgtgtctcgcatgccaatggttgccccggcggtttctgtgtttcagagaaggattgtggggacggctctgacgaacagacctgtcctgagcctgccggtcagtgcatagaagcacatgcaccatcacccagagctcagctggccccagccccctgcaggttctccaggcccctactccagagctgctaggatatgaagaaaaagcaacagagaggagggagagcagaaaacagagggagaaagcaaatagtggtcaggaaagaagcagagacggcagagggagcctctgaggaaaggagatgacagagaggtggtgacaaaaagcccaagatgcaaggggaggagagagttagagaagcaaatccagttggaaaagaggcaggaacataacccaaaccccagtctccaccacatgtcccataaatacagagggtcaagtcaagcagcccccacccaatgctgagaaagcaggagcttccttcagccagcctcagcgagcttggtccagaagtggcccccactcttgccagccacaggcagggcccctgtaagccaggcacccagagcatggtattcagcagtgccagcctcagggcaggcctgtaaagcttgtctcaagccggccacgcctgcaccccacctacctctctccctccaaaactagagaaacccctgcctttcccccaaaagcaagcagacccctgttcccacacctgccagaaaggggaaatgaaatgtttaatgttccctgcacccagcctttctgagcttcagtgaggggccctccaggagccttctcctcctcctcatcctgaccacgtgggccatggtgcatgctgcagtctatgcagtttctgtgtcttttctgtttgttattttcccagtgggggggttagggtgggctgagggtgggttctgggcagggggcccaagctgggatcacagagaaggctgctccaccaactcccgctttgcctctccccttcttcccccaccgccagacaatgactgtggggacaacagtgacgaagccggctgcagccactcctgttctagcacccagttcaagtgcaacagcgggcgttgcatccccgagcactggacctgcgatggggacaatgactgcggagactacagtgatgagacacacgccaactgcaccaaccagggtgggcaccaggggcccgtggggtggggatgagatcgagccccctgcatcagacacccagcctatccatctgtctttcagacccacggtgtgtcggccaccatctgggagccagaggtagcctaggcatggctcttgtccttcaggagctcccggtcctgtgggagagggaggttgccgaaaaatcattgccacacgctgttaatatcatgcgctttgcagttggtggccttgggtttgagctccagctctgcagcttattatctgggtggccttgagcaagttacttaatctccatgggcctctgtgagtttcgtctgcaaagtggggtaataatagcaccaacatcacagcgctgatgtgggagtttagtgagatcacgcacgaaaagtgctcagcacacggcctgtgtttggtaaatagtagcttgagaaaaggatgctgcaggcagggatgaatgagcctgaagagacagaggagagagggcctggctccacaaggctcccagtgccctggcctctggggcccagcctcgggggcggtggggacctagttttctggagggatgggccctctcaaggaatgctggcttcctagctctggaagatgtgcagatttttatgtgaaaactaccaaatttttaacactacagtattagtttctctcgtctcacagttctggaggctggaagtcccagacccaactgttggcagggtgggttccttctgaggccgtgtgggagattctgtcccaggcctctccccagcctccgcggtttgctggcaatctttgcagctccttggcttgtcgaagcttgacccgatctctgccttcatcttcacacggtgtcctccctgtgggcatgtctgtcaccagatccccatttcccctttctgtgaggacacctgtcatattggattaggatacacccttatgacctcatcttaagttgaccatctgcaaagacactatttccaaataaagtcatattcacaggtattatgggataggactaatatctttttagggaacacaattcaagccataccaactggcagttgattttagaagttttaaaaggctgggtgcaggccaggcatggtggctcatgcctataatcccagcactctgggagggtgaagtgggaggatcacttgaggccaggggttcaagaccaacctggttaacatagggagaacccatcttgaaaaaagaaaagaaaaaaaaaaaaggctgggtgtgttgactcacacctgtaatcctatcactttgggaggcaaggcaggaggatcacttgtttccaggagtttaagaccagcctgggcaacatagtgagacccctttctctacaaaaaataaacaaaattagctgggcatggaggcacatgcctgtagtcccagctactcagaaggctgaggtgagaggttgagcccaggaggttgaggctgcagtgagctgtgagctcgccactgcactccagcctgggtgacagaataagaccttgtctcaaaagaaaaaaaaagtttaaaaaaaactacagaccaaactcttcctgcaggcctcatctgacccatggaccactagattacagcctctgccttatagagttagggcacattcccaccctagtaggagaagactggacagcgttgagtgcccaccttgagccctgccctgagagggaggacagagaaggccacaggaagcttgggaaatagtaattgcgtctccagggctatctctgtgaaggggagggtgaggggcacaggtgatatcccttagggttctgagaaggggcctctggaggctgtgtggtgtggtgagaagagctccctgccgctcccagataagctgggcaaatttggacaagttgcttcccctgagcctgggcatcctcctttatgaaatgagctgaggtatgtgaggcctggcgtggaggagcagggtgtcactattggtagcagttgttaactatggtatgagctggatggtctgggaccattcaggaggagttgtgtttagactgcaggtaaatggacaggagggagggtcttccagtggggatggcatggtccggagaatgctgtcgtcaagacttagagggtgaaactgagcacttccgtagggtgacagtggggccaggtggagccgttcagaccgagggaaaggctcgtgcagggacagtggggaatgaggctgtcctcaaagggggcagatgatgacagcaggtgtaaatcgtgagaggcttgatttgggaggcactgggaacctttgaaggatttccaagccggaaggtgctgtgatgtaggaggtgatttcggaacacagccctagaggaagattagattgagaagaggttcaggggccccaagaaaggaaaatcagttcagagactgctgctgaaagtcccggcatgagatgagagcatcagctgggtccagggtagggaagggggaggagcggggtgtctgtggcagcatgagtgtatgagtgtggggctccaccaggcagtgctcctgctcctctcctggcctcctgagtcagatctcaggacagcagccagagtgatcctgacaacataagtcagatcatgccctggccctgccctccagcctgtactggctccctgcacccttggaacaaatgccaagcccctctgcacggcctgcagggcccccacccctacccctctgacctgcattcctgccctcccctccccctgcactctactccagctgtggcgttttcttttttctttttttttttttttgagatggagtctccctctgtcgctcaggctggagtacagtggcgtgatctcggctcactgcaagctctgcctcccgggcagctgtggcgttttcttttctttcttttttttttgagatggagtctctctgtcgcccaggctggagtgcagtggcgcaatctcagctcactgcaagctccgcctcccagttcacgccattctcctgcctcagcctcccaagtagctgggactacaggtgcctgccaccacgcctggctaattttttgtatttttagtagagacagggtttcaccatgttagccaggatggtctcgatctcccgacctcgtgatccgcccgccttggcatcccaaagtgctgggattacaggcgtgagccaccgcgcctggcctgtgtgctgttttctgaagtgctggcgtagtcctatctcggagatgagactttgcagcggctgttccccttgcctggagtgtgcctccagggatcctctgggctcactcgctcttcatgcaggcctctgctcagattccttctgcccagaggtcttccctgaccatcttacctgacagatcacccccatccctctcagcttctacccagctttatctccatagctttatcaatacctgaaattacagtctagatttatgggttatgtcttgtctctcttccccattagaacctaagctccatgagggtagggactttgtctggttcagtgctggccccaggacagcgcctggcacacaggaggcactcagtaaacatttgtggcatgaatgaatgaaatagaggctaaggaggtgggcatttgggctcaggccttagcaaattgcttctccagctgagatctccggtgtcaatggggggattagatgaggtgattgtggggcccttggaggtgtgatgcctcctgactctactactgagttggtgcttccaaggagtgtcagcaaagcttggcagactctccaggcctgcctctgctcatatccccaggctgggcttaccggggtggcagggcacagggatgaggagggctgacctgggcaacccctccctcctgaggccctccactgtccctctgcagccacgaggccccctggtggctgccacactgatgagttccagtgccggctggatggactatgcatccccctgcggtggcgctgcgatggggacactgactgcatggactccagcgatgagaagagctgtgagggagtgacccacgtctgcgatcccagtgtcaagtttggctgcaaggactcaggtgaagaggatggttggagggcgtctggaacagcacaatgtgggcaggaggagaccgtgttgagagcagagtagcggcaaaggggatggcactgtgctgtgtggagtggtgctggggacagtgcaaggcaaaaggcagtccagaggaagcttgtgtgtcatgggtgggggaaggcatgaagggccagagcctgcacagaggacctgagaagccaaaaccctaccagagttgagcttcagcacctcctgctgcagattcctgccttgtttgttgcctatgtgaatttgacccaaaaagcctcggggttcctcgtggaccccacagcgttgcaatcctgaccctattagagaagcccacagggtctggaaggaagggcagggggagccccagtccccgggcctgggccctcatagtgcacctgtccctcagctcggtgcatcagcaaagcgtgggtgtgtgatggcgacaatgactgtgaggataactcggacgaggagaactgcgagtccctggcctgcaggccaccctcgcacccttgtgccaacaacacctcagtctgcctgccccctgacaagctgtgtgatggcaacgacgactgtggcgacggctcagatgagggcgagctctgcggtgaggcctggtcccaggagaagggtagggagggtggctgggtaggagtctgggccaaggacagtctttgggggacctgagtctaggagagagcagctctggcagccgggcaggcgagcagcacccagagtggtcaccagcagcctgtgtggacctggcgctccccatggcgctgtgctgagtgagccacgccattagagcagtttatccacaaggcatccctgggggccaggtgctctgttttctccgtttgacagatgggagcactgaggcatggaggggttccatagtggtcccccagacttgggccaaggtagtacagctcctaaactgctgtggagactcagaccccttgcccacatgcataccacagagagatgcggagtgctcttgtggagacaaaggcaccagggttgactgctgatggtcagggcaggcttcctggaggatgtggggattgcatggggttcccaaggacaggcagtacttgcagagtgagtgagaaggcatgggggcaggcgcggtggctcacacctgtcattccagcactttgggaggctgaggcgggcagatcacttgagctcaggaatttgagatcagcctggccaacatggtgaaaccctgtctctgctaaaaatacaaaaattagccggacatgtctgcagtcccagctacttgggaggcagaggcaggagactcgcttgaacctgggaggcggaggttgcagtgagccaacatcctgccactgcactccagcctgggcgacagagcaagaccccatcccaaacaaacaaacaggcaaggggaggagggtgcccattcaagaccaaaagagatgaggttgggggagtccaggagtcagggaggaccatgtggtgtgacttggggatgaggagcagagcagccttatctggtcctcttagccaggcagagcccccagttccttggaagggaggagtggaagataaggccacagggactggctgggagaactgccgacaggctatcagtcaggctggcagtttccagggtgtgccagaggaccaagggtggtataggccctgctgcaccccaccccaaacccctccaaatcaggagagatcagcacaaggggactggacctaaggacctcccagggtccctcccagggaggcaaaaagctggggcccccgccctgggcccaagaaggcaggaacatatcgagaccagacagagatattgaggggtgctccctgtgggaaggggaggtatggtgccagctggtgggtgcaagggtcccaactctggtcctgagggagcccaggaagtcctgggctgaagctcagcctgaagctcagcaggaatggagacgaatggggccgtgggcagggcacaaggacttggtccaggctgcccaggacttggggcccagcagggccgtggtcttgcctcctctcagcttctgaccctgggtctgttccatgcctgcccctcccctagaccagtgctctctgaataacggtggctgcagccacaactgctcagtggcacctggcgaaggcattgtgtgttcctgccctctgggcatggagctggggcccgacaaccacacctgccagatccagagctactgtgccaagcatctcaaatgcagccaaaagtgcgaccagaacaagttcagcgtgaagtgctcctgctacgagggctgggtcctggaacctgacggcgagagctgccgcagcctgggtgagacaacagtgaggtgtggtggggcaggccgaggcaggcctctgagctgcagtgggttgggcttggtggccaggtgccaaaggctgagttttccaccctagcccccagtgcccggaccagcagagacctgcctgcgccaggacgggtggcacacaggcagctagccccttgctgaccccatcacatccctcccatcccagaccccttcaagccgttcatcattttctccaaccgccatgaaatccggcgcatcgatcttcacaaaggagactacagcgtcctggtgcccggcctgcgcaacaccatcgccctggacttccacctcagccagagcgccctctactggaccgacgtggtggaggacaagatctaccgcgggaagctgctggacaacggaggtgaccaccgattgctgccaggcaggatgcacacaggcggagcgctcaggcgctaggggccacaggtcccatccaagtggccccaaagcagaggcttggctcccccatcccccacacttctgttcattgggttagattttgctgtgggtctccatgcctgacgccccgtaattatcgtcagcagaactgccagcctgataattaacaaaatgatcagccttacctttgaatggcctggagctctgctccccagatctagaattgcaggcttgaaagaaaaaagccacttaggagtggcgtacctgaacgctgctttctgtcccaggcagcgtggtgcaccccagacttccttcagtcacacacaatagtgagtgcccactgtacacactgggcagtgggcatgcagcagtgatcaaaacaggctgttttcagttgtgtggtcaaggaaggtcccctgagaaggtgacatctgagcaaaggcttctaagaggcacattttactagagaagtttgtattgtttgtaataatacaaacttgaatttgaaaccattacaaatgtccatcaacgaggggggaggctaagtaaactgtgatgatatccacactgtgcaacagtctctaaaacaatgaggcacacacataatgtattagcatggaaaaatctttatggcagtcacttgagctcaagcagttgaggctgccgtgagccatgatcatgccactgcatccagccttggtgacagaagaccctgtctcaaaaaaaaaaaaaaagttggggagacaataggagtcctactcttgaatatgggcacatcagaaactttggcagaagtgccagggttgagggtgggtcatcgagggctcccaggatttcacacattcatgcacagctccccaggagacgctaacctttcactgccctctcttctccagccctgactagtttcgaggtggtgattcagtatggcctggccacacccgagggcctggctgtagactggattgcaggcaacatctactgggtggagagtaacctggatcagatcgaggtggccaagctggatgggaccctccggaccaccctgctggccggtgacattgagcacccaagggcaatcgcactggatccccgggatgggtgaggaccttgcccagccttctcctggccccatggcccccctgaagtcccattcagcctggccagggacaccttactcctcagtgccatctgcctcctcccaccctctacctacgatcccaccacagtcgctccctgagggccctgactttagccctcctgacccctccccactccccaggatcctgttttggacagactgggatgccagcctgccccgcattgaggcagcctccatgagtggggctgggcgccgcaccgtgcaccgggagaccggctctgggggctggcccaacgggctcaccgtggactacctggagaagcgcatcctttggattgacgccaggtcagcaccctctgtgccctgagaaggcccaagtctgtggcaccaggacggggtggggaggaacctgtggtgatgagggtgatgagaaggaccaagggatctagaactaggaacggtggcaaaggactgggcacaggaggaggaggacggaggggcgtggggaggccagggccgaggggagggggcaggtagaggaggcggaagcagggccatcagctgtggttattcacactgtaccatcctctccactcacctgtcctctccactctgttccctctgctggggctgtgtctgcccagagggaggggaaacttctttctaattggtctgcccagggagggtgcctttttcttttctttttttttttttttttttgagacagagtctcgctccgtcgcccaggctggagtgcagtggcgcgatctcggctcactgcaggctccgccccccggggttcacgctgagggtgcctttttctgactttcatcaaagccctgagtgctgacagcagccctggggagaagtgaccgaaagattcccttggggcttgggaatcggggcctgagaggtgaaacctggacctgttgggttctcacaccttggtccttctgtctgtctgctctggccagcaaggcttaggggagggaatggtcccatgctcttcgctgggagggctgtggccagggcccagagggtgggcacctgggcagagctctgagggctgagatcccagctggcatcctcattctgctccatcatgctcttaggtcagatgccatttactcagcccgttacgacggctctggccacatggaggtgcttcggggacacgagttcctgtcgcacccgtttgcagtgacgctgtacgggggggaggtctactggactgactggcgaacaaacacactggctaaggccaacaagtggaccggccacaatgtcaccgtggtacagaggaccaacacccagccctttgacctgcaggtgtaccacccctcccgccagcccatgggtaaggggctcggggcctcgagcagccggaagggagccagcagcctctttagaagctgtagaagctcttaggagaggagagggcagtgagaacaggagcaagtctgtgctgggatggcaggggtaggccggctgttgacagaggcactgtctagcagcagagaagggtctagtagtagcggctgctggaacagggggaggagagtgggcgaggaaggggtggtccatgtagggagcagcaagtcacaggatgctctggcttcttctcttctccaccctgcccccagctcccaatccctgtgaggccaatgggggccagggcccctgctcccacctgtgtctcatcaactacaaccggaccgtgtcctgcgcctgcccccacctcatgaagctccacaaggacaacaccacctgctatggtaggagcccctccctccagagccagtgagcaactgaggctggagggaaggccgcaggccccaggatcccggttgtcagctaaggcagagtcccagtcgggagggtcccgataggagaggctccagagacagccactgtgagaaggggctgcaggtctgccaggggggctgcacccagcggggtatgtccacggagccaagggccagtagcaaacagacggatccagaagaaggcagggcctgaaaccggattggtgggaagcacagaggcagggactgccttcagtgaccagcccatgccccacagagtttaagaagttcctgctgtacgcacgtcagatggagatccgaggtgtggacctggatgctccctactacaactacatcatctccttcacggtgcccgacatcgacaacgtcacagtgctagactacgatgcccgcgagcagcgtgtgtactggtctgacgtgcggacacaggccatcaagcgggccttcatcaacggcacaggcgtggagacagtcgtctctgcaggttcttcctggccctggatgcccaccagtggacatgggcacctccacccgccccttgctcccaaccctggtctacttggtccgagtggtccttctcccagtcctgttccccctcagtgctccagcctggtttcctgatcccttttctccagaaggcacactggctcccctcctgacccactgccctgcagacacccaacaactgactccctacttgtgcccccagacttgccaaatgcccacgggctggctgtggactgggtctcccgaaacctgttctggacaagctatgacaccaataagaagcagatcaatgtggcccggctggatggctccttcaagaacgcagtggtgcagggcctggagcagccccatggccttgtcgtccaccctctgcgtgggtcagtctagggcccagggccggggagcatggggtgtggggctgggaagaagaggaccctgacctttccctcttggcaccctccccccaggaagctctactggaccgatggtgacaacatcagcatggccaacatggatggcagcaatcgcaccctgctcttcagtggccagaagggccccgtgggtacgagcttccctgcccacccccacagcccctccctaattccttgaccagcaggtgcttgcagggtccttcagttgcccctcagcctccccagagccctagcttagtgcctgttctcaccatctgctcccttccctggatccccagccctgggccagactccccggcagtgactcccccttttccaggcctggctattgacttccctgaaagcaaactctactggatcagctccgggaaccataccatcaaccgctgcaacctggatgggagtgggctggaggtcatcgatgccatgcggagccagctgggcaaggccaccgccctggccatcatgggtgagggctgctgggcgaagcagagatgacgcagagcaggccaggccagacctactgggagacaggggctggcttggggcagtctctcaccatgtggggcgggcctgatgacttagggccaatgggcccttcaggagagctgggtgtggggccttcccaagggtctcatcccctcctgctgccccaggggacaagctgtggtgggctgatcaggtgtcggaaaagatgggcacatgcagcaaggctgacggctcgggctccgtggtccttcggaacagcaccaccctggtgatgcacatgaaggtctatgacgagagcatccagctgggtaggtgcgaggccgggcggccgctgggggctcaggggcaacaggggagccgtccagagctgcaggctgcagggccatggggcaagggagtaagtgggttaggctgtacccaccacccaaaggggctccttgtttccttaccacaaaggcgccttgtaggctcccagcagccctgttcacaaggccaggggcccaggaggacagaaaacctgagagctgggtagggtggtgacccccattaggtccagggtagtcagtgaccatcctgtttctgagcagcccaagcctgaccctgaggtcccaaggagggccacctaaccctttccctctgcctcccacctgcccccagaccataagggcaccaacccctgcagtgtcaacaacggtgactgctcccagctctgcctgcccacgtcagagacgacccgctcctgcatgtgcacagccggctatagcctccggagtggccagcaggcctgcgagggtcagtgcctggctttcctcccagccttgtcccagctccccaaccctgacccctcctaccctacagccccaccttcctcttcttaccttggggacaagactacattcgtcgtgtaggggacactggactatgaagtggctatgactctccagtgcctccagtaggattttggaaaaatagatgtcagcaggcagatcggggcagctgcatggaagaggcatgctctgagctgggttttctaggacaagtaggatttggatgcattgttcaaaggagagggaactatacacaaggcaaggtgtgtgcaggagccccagccaagagtggtgggcaaagtgtggggaagtcctggagataaggctgtgagctaggcggggctcctgtgttctgagccaggagtgcctggaaagtgatgtttggggaagatcaacctggccgcaatggtggtggggaagaaacagaggcggttaaaccagttaggaggccattaggagtaatcagagtgtgagatgatgggcctgggctgggctcagtaagggttgaagaaaagaaatgaaacccagacgcatttcacaagaacctgctaactgatttatgagcttgctgggggacagcatttcccaaaagtgcattcctaggagcctccctctttgatgtgggtagattttaccaaaagaaactctgagttgaacaaagtttaaaagtgttttgtgctgcagaacttctcagagccttgaatatgtttatgtgtgccaagaatttttcaagcgtttggggttttccaaaactcacttgaccattcatttttttttcactgagtctgagcaaccagggaccatgtggggattcactttgggatgtgctgtatcaaagggataaaggcaagggaggattctgaggtgcatgggtagtggtgcctcaagacatgggaaaactgggccaggcgcagtggctcaagcctgtaatcccagcactttgggaggctgaggccggccgatcacttgaggtcagaagtttgagactagcttggccaacatggcaaaactccgtctctactaaaaccacaaaaattagctgggcgtggtggtgggcacctgtaatcccagctactcagaagacctaggcaggagaatcacttgaaccgggaaggttcaagggttgcagtgggccaatattgtgccactgaactccagcctgggcgacagatcaggactccatctcaattaaaaaaaaaaaaaaaaaagagccaggtgcgtggctcatgcctgtgatcccagcactttgggaggctaaagagggcggattaccttgaggccggggttcaagaccagcctgaccaacacggagaaaccctgtctctactaaaaatacaaaattagccgggcatggtggtgcatgcctgtaatcccagctactcggaaggctgaggcaggagaatcacttgaacctgggacgcggaggttgtggtgagccgagatcgcgtcattgtactgcagcctggggaacaagagtgaaattccgtctcaaaaaaaacaaacaaagaaaaacaaaagaaaagaaaagaaaaagaaatgggataactgggaatgagactggcttcggagtgaccttagggggttgagtttttgatgttggagagagggtgtggcatagaccagacagagggaggacaaagaggaaactaggatcaggctgagcaccaaactggaagtctagattttggagtcacctagtcctgattgtctggtctgaactcccagactttccctaaggaacttgcaggggtgcagggttgggttgtgctgggtggaggccggcagagcacagggtgagaaatccgagtctctgctgccctctcatggtggctaggggtcctgcaggtggttccccagagctaccagccaggtgcgcttcctcccggcccatgctctggcctcaggctagggtgtgtgtgctgggtggaggatagggatgatggtggggggggatgatatcaaaggagaagcagagaacagttggagggtgacaggaaccaagtttaagggagtgttggcgatacccatgccttaagtttccttgtctttcaggcgtaggttcctttctcctgtactctgtgcatgagggaatcaggggaattcccctggatcccaatgacaagtcagatgccctggtcccagtgtccgggacctcgctggctgtcggcatcgacttccacgctggtgagccatttggtggcagagggagttgggcgtggcgtaggagctttaggggtggtgtggtgtgccctgagggtccagtgagaggctgcctgaattggcctgaggtggggcacttgctacagctgccaccctgactccacctccccttcaagcacctggcccctccggcactctctcacctctgtcttgagccttgtgagattttgacccctcaccttacccctgccttattgggcatccccatgtcacctcctccacctccagaaaatgacaccatctactgggtggacatgggcctgagcacgatcagccgggccaagcgggaccagacgtggcgtgaagacgtggtgaccaatggcattggccgtgtggagggcattgcagtggactggatcgcaggtgagcagtgggcaggtttgtggggcttggggtgtggcagaggactgggggacgaagtgagaggaggagttggcgggagcaggaagaggagctgtaggggtgcctgggagcttggagacaccaggtccacctgtcctcacctaacctccctgagccccaccaactccctccttaggcaacatctactggacagaccagggctttgatgtcatcgaggtcgcccggctcaatggctccttccgctacgtggtgatctcccagggtctagacaagccccgggccatcaccgtccacccggagaaagggtgaggagctggaaagactggccttgtcattctgcccatggcccatgctgatgaggccctgtctcctccagggtctgaggactgacccccacttccacccccaccctacaggtacttgttctggactgagtggggtcagtatccgcgtattgagcggtctcggctagatggcacggagcgtgtggtgctggtcaacgtcagcatcagctggcccaacggcatctcagtggactaccaggttcgcacgccaacttggccttggatccgatggtagacccctgacccaggctcctgttccctgtgatgagcccattctgggaggacttggagcccaggggaagtcacagggtctcccagcccagccctccacccagagtaggactcctgctaccacagagatgatgggcaggggtcgctcagaagtggggagtgggggagtggagagatgcctggaggtcaccttatcagcagggcagtgggcaggagtgtatgcaggaggcaggagtgagttaggggaggctgaactgagggcctcactctggcccaggcactccctgctgccccagacatggggctggcagcgagctcagccctggaggtgaggtgggtgcctctggcctgtaggatgggaagctgtactggtgcgatgcacggacagacaagattgaacggatcgacctggagacaggtgagaaccgcgaggtggttctgtccagcaacaacatggacatgttttcagtgtctgtgtttgaggatttcatctactggagtgacaggtgagggcttctgtcctggcctcctcagctgatctcttccttccctcctgcctccactgatgccctgcttgtgccctgtccttccctcaggactcatgccaacggctctatcaagcgcgggagcaaagacaatgccacagactccgtgcccctgcgaaccggcatcggcgtccagcttaaagacatcaaagtcttcaaccgggaccggcagaaaggtgaggctggggctctgggctggggtggagaggtgagggggactctggcctgggagagtgctccccagggaacccagtgtgagagggctgggagacaagttagacccatggggcaacttccgatggcccgagagacccagggatggggaggaaaggctgaggtgctctgggacagatcttggcattggactctgggccctggagggtcattcaagctgggaataccgaggcagagggcagagctttcgccaaagcctggatgacaaaggcaccagtgagcctttcccaaggcaggccctgccctctgtaccctcccctcccccaggcaccaacgtgtgcgcggtggccaatggcgggtgccagcagctgtgcctgtaccggggccgtgggcagcgggcctgcgcctgtgcccacgggatgctggctgaagacggagcatcgtgccgcgagtatgccggctacctgctctactcagagcgcaccattctcaagagtatccacctgtcggatgagcgcaacctcaatgcgcccgtgcagcccttcgaggaccctgagcacatgaagaacgtcatcgccctggcctttgactaccgggcaggcacctctccgggcacccccaatcgcatcttcttcagcgacatccactttgggaacatccaacagatcaacgacgatggctccaggaggatcaccattgtggaaagtgagcccagaccctaagtcttcccaggaagtgggacatggggcggggagcagcacagactcttagaccccagccaggcactctaccctaggtctgaatcccagcagctacaactcagctgaatccaactgcacccccgcagttacatgactcctgatttggagtcagcgtcagcccccgacttcctcccgccactggtcctagttctgccttcagagctgcacagaacaagcgagaggtctctgtggagcccaacgctcacaaacccaggctgcagacatggggctgagctccagtcacttgggctttcaataacttgggtcagtttcctgctcttgccaagcctgagccttctcatctgcgtggatgagtgtctcatctgagacaggattcctcgagctgctgcgcaggaaggcttagctcagtgatgctggggacggagtgtgtgctctggaaagagcagttacagtgtcagggctgtcatcacaggacagcctttcagctctttgaaaactgcatcctgctacattttctcttcttcagcctggttaccaccgggtcccttgactcattcatttgctcatatattcattcagctggtccataaagacctgccaggcaccgaactaggtgctacgtatacagacctgtcctttcagccttttctgggacattttctgctgcacatagtccagcctgcatgtctgtctaaaaatgtagcatccgaagctaaactcggtactccatgctcgtagcttgatcaggagagactggcacatcaatccccagacccctggaagggatgtcccctcacctccggctgtctgcagaccataccacagcatggccctttggcagccaccatcgcttatagccactaacactctagtcttttctcttacactgctgttcggctgtgtctctcactgtgccttggttctttaacctgagtttaagatgtctgctttataaaataatcaatccagctcagggtctttttaagtagggggctccccagtacagcccaagcaggatttgatttacagaaatctacattgcactcagctcagcagaactgcagctccaggaaagtgcaaacacaccagaaagcccgattgccctcagtgggagagggttgagaggtgaccacaggtcatttgagtgaggacagcagaggttgggggcactgagtcagaccctggtgcccccgagccctctctgctgcacctcttgcactcccataccccacacttcgccttccagccaggagagcacctgccccaggctgtcccccacggctcctgtgcaggctgccctctgggccctcctgacaaatcgctgctcctgtctcttcacagacgtgggctccgtggaaggcctggcctatcaccgtggctgggacactctctattggacaagctacacgacatccaccatcacgcgccacacagtggaccagacccgcccaggggccttcgagcgtgagaccgtcatcactatgtctggagatgaccacccacgggccttcgttttggacgagtgccagaagtgagctgctgcctggggatgggggtagcagggagaggtgggactcggggtggcagaaactccccaggcagatccaagcgggggtgcaggagaggcaggccctcacttgagctccacccttccctgctgtgtgatctggggagaggtgcaaaagcttcctaagcttcaggttcctcttctgtgatacaagctggctaagattccagctgcctgcaccaaagggagcatcaggactgtgggggacgctctgcctttgtgattgattcattcatcagagcaccatgttggaggcacagggtagggcctctagctctgggatccaaagcttcaggcaaagaatgtttgtcgaacccttcgtacagaagcctaaggctgggcctaccaagccacctagctgggttgagaagtcatacttgtgggaagtaatggtaactggcacagggctgtatacgggtgaccacaggtgtcatgaaggcagtagattggcccagagcctggaactggaaaagacaaggaaggccagctcggacaggggaagtgctttgagcaaaagcctgaagaaaggcaaattcaaggcagggaggacagagggggacctctgcatgccatagagcataggcaggcctgagcccagccaggaagtgaggtcagggtgcggaggagttaggagcacaagccaggacaggtggcagaaagcacccgggggtgggtgctccccctggagggttcacccgcagtcagcctgctctgttctcccgcaggggcagccctcatcccggctgtttgggcctctagtgagccaccccctcgccttagggatccaggcccacatgttagcaacatttttttcccaattcagcagtgcttggaatgtttttcaaaagctttactaggaaactagtaaacacaacccaaagcagctgtatagatacgtgagtgtcccgaacccagattccccccaccagtcccccaatgtcagtcacctccaacctggctcaaggaccctctgtttcctcctgcctctgtcatctggcacatctgcagctgatgatgaaggtccagtccccccttccatgaccctcggctgcctcacctgtctggggatggcctcagagcctgtccctcatgagtctggagcttccctggagggtccagcaaggctgcctggccctcgtcccagaggacgtgaccccctggctgcccaccaagctcctttcttatgaggccaggggattccatcacgcattcagcgagtggcttttgagggcaaagaaggtgcagaggacccagtggggagcgcgaggggcgtcatgaagagcttcgtggctgtgtgctgaggactggccccacctggaagtcagggaacgtgtccttgaagaggcggcatgttagccagcgtctgaggatggcaggagtggctgggtgggagcatggtcccagtgcccaggagaaagagctgagctggcaggaggggccctccccctggccacaaggagcaggcactttcggggaatcagaaggagccagtgtggaccccagtggagagggcaggggcaagtggagactccaacaacccagcctcctcctgagccctccccgcgtcagcactggagcactgatggccctgtagagctcacagtaggatagttagaaggtccgccatgttcctggacactgagcacctaccccaggaaagcctctctctccctcctgccccattcctgggaagcaggttcacccagaccacagttgtgtcacatggaggagtttgttgacgccaggaggaaaaccacttctcactgcaggtgtgagtagtttcacctgaggtgtaggagttcctggtggggactgacaggccaagtccaatcctgacaagccaggaagatgactggccactgccccaggatacccattttcccttatggaggctagaaggacacgccgcctccctcccaacttacatcccgattccagagccaccgcaaacccctgctctcctccaggatgaggcccttaagatcagagcttctcacgagctcgccgaggctcagggcagccagtgtctccagaggggcagagcagcaccattttcctacgtgagcccagcagaaggcgggatagttcaatggtgctggagacgctgggggtgggcaagaagggtgtgacctggagaggtctgaggagacaagttcacaggccagaggacagatctgtggccagaatggtgaggggcagaggtaggaggaggccagaggcactggggtgggggcgggggcaggtcctgttagggaactggagaacggagctggcttttgtgtggcttggtggtctcagactccactgtgcctaaggatcgcctaggagcaagagaatgtggagtcccctgccccgccctgggcctagctgagtgacaagctctgggaccgaggacccagggctcaccatccaatgccggtggtccaaggaccactctgtcacacccagggtagtgcatgaccagccctgaggccttccacagcccccctccagcctcagcaccaccccacaaggagcacggcataattgggggctggctgttcccattgcctcctttactgagaggaaaccagggctcagaggggcgacaggctcattcaaagttggagccgttacgaggcagaacggtggctccaaccccaaacatgcaaaggcctcaaagtacggagaaggggactcttgagagctgcttgaggataggacccacataccccaggacctgggacacatgccacactcagctccacaagggcttcctgaatgatctggaagacagccagcctccctgcacagaagagagcagttaagaataaactcctgggaaatactcacatagtgtgtgccatctgtccttaagatggagattaacttcttccactctcacatcctgcgaggcaggtggtgctaccatccccacctcatagaggaggaaactgaggcacagggcagttgagtaagttgcctaagggcacctagctggtgggtggtggagccagggctggaaccccagggcctgtctcacttggctgcaccggctctcttctcagcaagtagacggtcactgcccagatactgcaatgtgaatatctcacacttggccctcatcccctcacactcagccacctcgtgtgtgaactgtctgtgcaatagtggggcccttcctgggcattggggcactgctggcctctatggctctggggtggctttgccctggcaggcttccaggttccaggtgcctacgcgtcctggcctgtgccctctgttgtggattctcaggctttgcctcctgatctctggaccctcttcccccagcctcatgttctggaccaactggaatgagcagcatcccagcatcatgcgggcggcgctctcgggagccaatgtcctgacccttatcgagaaggacatccgtacccccaatggcctggccatcgaccaccgtgccgagaagctctacttctctgacgccaccctggacaagatcgagcggtgcgagtatgacggctcccaccgctatgtgagtctgcggggtgggtgagctggcgggcggctgaggggaggccagggccagggtcagccgtcaaccaagaccgtccaggcacagacatggtgggaacagctgggaggaggtgagtgcctccaggccccagcctcggtcaaccccaccctgtccagcttgctcctcatcagctagacgagggagatagcaggatgcctctgcgggccctcattctgtagctgtcagaggccaggccaggctgtggtccggtggagactgggcaagaggcctgagcgatgctgtgacggtgatggtgctgtctccacaggtgatcctaaagtcagagcctgtccaccccttcgggctggccgtgtatggggagcacattttctggactgactgggtgcggcgggcagtgcagcgggccaacaagcacgtgggcagcaacatgaagctgctgcgcgtggacatcccccagcagcccatgggcatcatcgccgtggccaacgacaccaacagctgtgagtggggctgccgccagctgcctcaccctcctgcctgtcgtgcatggacatacaaacacacaccccacacacacatcgcacataccacacgcaccctacacataccacacacacacatcccacacatactacactacacacaccacaccacatacacacaccacacccctcccacacactcaacacatacacaccacaccatacacaccccccacacaccacatacacatacacccccaacacatacacacacatacacaccccacatacacacaccacacatatcacatgcacaccccacatataccacaccacacacataccacacacacaccacacaccacatacacaccacacataccacacacaccccacacataccacatacacacaccaccacacacactacacataccacacacacaccacatacacacaccacatacacacaccacacatgacacatacacaccacacataggacacacatacacatgccacacacctaccacccacaacacacatcacacacacaccacacagcacacacacacaccacacaccacacgtaccacaaacatgccacacacacacacacacatctcacagacatactataaacaccccacaccccacacaccacaccccacacacacttgcctggtcctgctctccctgggcctccattacacagacacacacagctgtacacacctttggaaccgcaaaacccccagtgctcctgtaccccttcccaccaaggcatctacgcacacagatggactctgcacacgcctggcatctcctccacgttgcacacacacattcatgtcacacccgcccctcagggctcatccatgccctcggtgcccctaccctcaccctggtcactctcctcacttggagccacacagacagccgagagcctgggtgcacgtgccctcagtgggcacgagtacatgccccagcgccccccaccacagacctgcagctttcccaggtgtctcccatgcgccctggggctcactactgcacccgtgatctcagggccctcagactcgaatctctcagaaacactcctcaaagcccacggtgccctgcctaaaagcacacacatcctcaacggcacacctgccgaaaaccccatgcacctggccctcccacagcagccatccccatgccctccccactggctgcaagccgctgtgcctgccgtgactgagcagaggcttgggagctccatgaagtcagtgaatgggtgggtgcactctgggtgcatgcacagcagagaacactctccagccctgcgcccaccctgtccctgctcaggtgaactctctccatgccgaatcaacaacggtggctgccaggacctgtgtctgctcactcaccagggccatgtcaactgctcatgccgagggggccgaatcctccaggatgacctcacctgccgaggtgagagaggcgggggggaggggctggcggggaacccaagcacacaccagggatggtgaccatctcccctacatgctccagcccagccccccaaagccttttgccaagaagacgctgatgatgacctcagctccccgggggaggaggcgtgggcactggggcccacagcgctggctcagaaagctccctccacctccctccccagcggtgaattcctcttgccgagcacaagatgagtttgagtgtgccaatggcgagtgcatcaacttcagcctgacctgcgacggcgtcccccactgcaaggacaagtccgatgagaagccatcctactgcagtaaggagccccctgcagcccctgcctcttccaggcccagagcccaggtcctcctcccccaggcccctgcaggatggagcaggatcaggacccagcttcctgaccatgagttttgggagctcatgaagggcagaaccactgttagcctggactgggcctttgggtttgggggtggccagctggacacgtgcatgacgtctcagggaggcagccctttccctgtgcctgtggctgacacgcagcctactcctccatttgcagactcccgccgctgcaagaagactttccggcagtgcagcaatgggcgctgtgtgtccaacatgctgtggtgcaacggggccgacgactgtggggatggctctgacgagatcccttgcaacagtgagtgaggcgcactggcataacccatctgtacctcagttcctgccccacccctccctggccaagctttgtccctgggccccgtggtgtctggttcaaggcactctgtgacaggccagggcaggtgctgtgggccaggagctctgtcctgcgtccttctggcccccacagagaaaactctggcctgacgatacggggcgggcactgttctagagacagcctgtggtgtgggcgagttccgctgccgggacgggacctgcatcgggaactccagccgctgcaaccagtttgtggattgtgaggacgcctcagatgagatgaactgcagtgagtgacgccctttgctggcacctcctgggctcctccccatcgctcactgcatctcccgccttcaggccctcctgcacctgcccacattcctctctgccttccctcatccccgctgacagcctccatctccctgaggccctgtccccatcccgctcctgctcctgggctctcgtggggttccgagagggggcagtgagcagatggtgcagacagtgccccaccagaagggcaccgttcaacttttggaaacacatgaaggctccatagggctggcagctgccccagtcgggggtgatccagggggaaccaggtatcaccctcacccctgcccccaccaggtgccaccgactgcagcagctacttccgcctgggcgtgaagggcgtgctcttccagccctgcgagcggacctcactctgctacgcacccagctgggtgtgtgatggcgccaatgactgtggggactacagtgatgagcgcgactgcccaggtgggcgggggcaggtgtgtggtgggtggtggcctgcggtgagcagggccctcacacctgcctcgccccccaggtgtgaaacgccccagatgccctctgaattacttcgcctgccctagtgggcgctgcatccccatgagctggacgtgtgacaaagaggatgactgtgaacatggcgaggacgagacccactgcagtgagtgaccactgcacccactcagtgctccaagagcctgctgggccccacttcttagtcccccccagcaaatgcccccttggaaaagggcatccagagccttcaaccccctgccccacaccccaactcttgaggtcagactcagagactctgcctctagctgctgctgagcccccccacagaggggtgctgtgggcatctctcctgtccttcccatggcatcagcctccccaggtgggtgacccccacccttccccatctaactgtggcttctgactgccccagacaagttctgctcagaggcccagtttgagtgccagaaccatcgctgcatctccaagcagtggctgtgtgacggcagcgatgactgtggggatggctcagacgaggctgctcactgtggtaaggaagctgggattgggccgggggaggtgccccagggagggacagaccccacccaactccaccccacacacagacacccctgcagacgacggcgaaccatcacctccactgctagacctgatctacccgctcctaagtctctcagtggccctctctccccctacagaaggcaagacgtgcggcccctcctccttctcctgccctggcacccacgtgtgcgtccccgagcgctggctctgtgacggtgacaaagactgtgctgatggtgcagacgagagcatcgcagctggttgctgtgagtggcggggccacgtggagcgggtggacagcaaatggccacagtctcactttgcagatggggaagccggggtgcaggagaggaaatgcctcagcggggtccactgggggcggagccatagctgtagcccaggtgtccagactcctcatccagtgccctgcccactctaccaggagaaccacaggaggttagagtgagggacggtcggccgctggccaggcagggctgaagggctgtgtccacctctgtccacagtgtacaacagcacttgtgacgaccgtgagttcatgtgccagaaccgccagtgcatccccaagcacttcgtgtgtgaccacgaccgtgactgtgcagatggctctgatgagtcccccgagtgtggtgagccttcggcggtggtgggaggaggccctgccctctgccgggccagggcatcagcctcacaggtccattcctcccccagagtacccgacctgcggccccagtgagttccgctgtgccaatgggcgctgtctgagctcccgccagtgggagtgtgatggcgagaatgactgccacgaccagagtgacgaggctcccaagaacccacactgcaccagccaaggtgggccccagacctggctcccctctgccccctccccagactgcctgagaccccgctgacctgccgcctccgcccctccgcagagcacaagtgcaatgcctcgtcacagttcctgtgcagcagtgggcgctgtgtggctgaggcactgctctgcaacggccaggatgactgtggcgacagctcggacgagcgtggctgccacatcaatgagtgtctcagccgcaagctcagtggctgcagccaggactgtgaggacctcaagatcggcttcaaggtatgcccagccctggggaggagcttccacaccccagacgtgccaggaacgcctttctccactgccttattcattcattcatcccctagacagtggggatacagcagtgaatgagacagaaatctgcttggttggggtctgcctctatctggcaggtagagagccagcagatttgctgacagatgagatatgcagtgtgagaggaagagaggagtgaggcatcaagtaggcaagagatacacaggtctggagttcaaggagaggcccaggctggagagggaagtctgggagttatcaccatagagatgctatttgaatctgtgagcctggatatgattcccaagggagcagtgtaggtggagaagagaggagtccaaagtctgagccccgagctgagcaacagccaggagcagggaagtgaggggaccagcagaagagcctgagaaggagcagctgctgaggcaggagaacagccacgagaagaaagcatttccatggggagggcacacgcagctctgtcaaatgacactcgggggcacacagaaggaggcctgcactgtgggccagctgggtgggctcagtacccatatgctgctgcccctagtgaggccgggtagagggaattggagtctctgagccaggtctccagggtgggaggcccagaccctgccacatgcccagcccaaggctccctgtgcctgcagtgccgctgtcgccctggcttccggctgaaggacgacggccggacgtgtgctgatgtggacgagtgcagcaccaccttcccctgcagccagcgctgcatcaacactcatggcagctataagtgtctgtgtgtggagggctatgcaccccgcggcggcgacccccacagctgcaaggctgtgactggtgagatgcgcgcttggagggcatgaggtgacccaggctgtgtgggactgcccgggtggcagagctccagacaggcaggagaccagggccgctagaatgtgccaggagctgaggcaagatcctctgtctgcagacgaggaaccgtttctgatcttcgccaaccggtactacctgcgcaagctcaacctggacgggtccaactacacgttacttaagcaggtaccaaacccaggccctcctccccgctgcccatctcccagacccagcacagcctcccttgcaagtctccccgcttaggtccaaccatccctcccccagatgcaaatgtggcccctgttgccacaaccgacttctgctgtccttcactccccaaatccagggcctgaacaacgccgttgccttggattttgactaccgagagcagatgatctactggacagatgtgaccacccagggcagcatgatccgaaggatgcaccttaacgggagcaatgtgcaggtgaggcgggcggccctcggcgaccaacactggcccgcctcagatgactgttttcagatcgtctctccttcccgccccaccaacccaaattgcttccttctcactccactagtcactatatgactgcttgttctagctgctcactctcctctgggcccagacagcaaggactgggagattcctcttgcccttcccctcgctgccagcctcatgtctccttaatcatcaggaagttccctgtgaggtctggccaagcactgtgaggcttggggcgtggtcccattcacctagagccccctctcctagagcctctgctgacacctacacagtgtcaggcccaggactgggcattttacttccatggttctcccaccagagctgtcagagggagctctaccccattttacacgaggggaggctgagcctcacagaggcttgcaggtcctcccccaggtcacccagagctctccctcccctgccccttcctgcaggtcctacaccgtacaggcctcagcaaccccgatgggctggctgtggactgggtgggtggcaacctgtactggtgcgacaaaggccgggacaccatcgaggtgtccaagctcaatggggcctatcggacggtgctggtcagctctggcctccgtgagcccagggctctggtggtggatgtgcagaatgggtatgtggctgaggagggttgggggagcccctgaaagcagcatccaagcccagcctccctgcaggccactggtgcgatgggttacgggatctcccagggctcactgcctacccatcgccaggtacctgtactggacagactggggtgaccattcactgatcggccgcatcggcatggatgggtccagccgcagcgtcatcgtggacaccaagatcacatggcccaatggcctgacgctggactatgtcactgagcgcatctactgggccgacgcccgcgaggactacattgaatttgccagcctggatggctccaatcgccacgttggtcagtgtgccagtgaggctgtccaggcacagcagactcagtggggatggaggtctgaagcgacaggggatcaagttttgggggcaagagtggacataaaaagcggaggatatggcctgaggacaccactcactggggtgtggggttcagagcaccccgggggcttccccagcctggccaccacccagctcccttgggaaggaagaggagaggcccttcccttgtatacacagttctggaggactggccccaaggagggtgggggtgggaggcctgcgattgagaactgcagtgctccccacttcccgaggggagccatacactggcagggcaggaacttgccatgaggcagtctaggtttgaactccagctctgacacttgttagctgtgagaccatggggggtctgtaccatgaaccatctgtaactggggctgacacccacctctcagggtggtggtagggcttgaggaggtggagtgggccggcaccctgtccgagctccggctgactggcactgtgcctgccccttggccctgcagtgctgagccaggacatcccgcacatctttgcactgaccctgtttgaggactacgtctactggaccgactgggaaacaaagtccattaaccgagcccacaagaccacgggcaccaacaaaacgctcctcatcagcacgctgcaccggcccatggacctgcatgtcttccatgccctgcgccagccagacggtgagcaggcaaggggtgggagcaggcgaacggtgagccaggcaccggggtccctgggagttcctgctcatcccttctctagcattgaccaagccctcctggccagacactgggagactccaggagggtctagacaggggatggtctggctcccgggagcttcagcccggcctggatccagccctggagtctggcagcagcaagtccctgaggccagtcaagtgggggtctgggtgcccagcccccagaaggaaggcaggccggcccctgggagggaagcacagaggaggtggggagctggccttcaggcctggcctgatcctgggaccttagaatcctctcctatctccagcttcagctccctcctaaaagaggcagggttcagacccacccgcctctgtccaggatagagtgagtgaggcagcctttggtaggccagaaaatgtcaccatatttcacgacgttttctctggcagtgcccaatcacccctgcaaggtcaacaatggtggctgcagcaacctgtgcctgctgtcccccgggggagggcacaaatgtgcctgccccaccaacttctacctgggcagcgatgggcgcacctgtgtgtccaactgcacggctagccaggtgaggctgtcccccagaccccatcaccagtgcccgctccccaacccccaaatcctccttggaccccaacacctgctctgtcctaatgtcctcatgcatctggttttcccacactaacacccccacatttcttgcctacctcttgtctccccacagcaatacttttacccccgtcacctcacacagacacctccacaccctaaccttgaccctccttgccatgcttcagtgctgccttccccaccctatcccacgcagccccatacctggcctttccgaactcaccatagcccaacctgccccataacaccctgacccctgcctcaacttctttgaaacatccaagcccctcaaaagaaagacttctgagtcccccagacccccaccaacccctcttgcccccacctgccctccagtttgtatgcaagaacgacaagtgcatccccttctggtggaagtgtgacaccgaggacgactgcggggaccactcagacgagcccccggactgccgtgagtgcctgctgggggtgacaggagggcccccagctgtgtcggaggcctgactcctgaggctttgaatggccactggagaggctggggctgtggtgccctgcaagtggacctggccgtgtccaccccagccgctctgactctgagcctccctctctggcagctgagttcaagtgccggcccggacagttccagtgctccacaggtatctgcacaaaccctgccttcatctgcgatggcgacaatgactgccaggacaacagtgacgaggccaactgtggtaaggcgctgcccgcccaccctccctccttccccagcatcttccctgccccaggatttggggctttcaagtgcagggaagttgcagcccacggcagcttgctctccaggctggattcctatggctcaagcctgtgtcctccctgctgagggatgggcaccctctccctgcccctgagtcctcccttcgccacgaatcacctcctcctccctccacagacatccacgtctgcttgcccagtcagttcaaatgcaccaacaccaaccgctgtattcccggcatcttccgctgcaatgggcaggacaactgcggagatggggaggatgagagggactgccgtgagtgtcagaggtggtggtgggccggtggtgggagatgacacggaagcagggcaggcagaatctccccacagctttgagaggctctcaaataactttagtagatgggcaacacaaattatattgggtgtaacttgctttgctcataaaaatcatcatgcatgatatagagacatagagatccagaaaacaaaaagcaccaaaactggggataaactgttccttcctccgaagaagttgctggcaggaccaaggccagggcttggaagagagagaagacagtgatggtgaactggagtggcaggtgtaagggagggccctcattctcttgcccaccccacagccgaggtgacctgcgcccccaaccagttccagtgctccattaccaaacggtgcatcccccgggtctgggtctgcgaccgggacaatgactgtgtggatggcagtgatgagcccgccaactgcagtgagttgcctggcctggagcccagcttccctccccagtgtctgctgctcacaccaccccgacgtgtgaccccctcagtggctgctccctcactctccccaccctcccggcacactcctggaaggagtctcatcctcaccccatgcccacccgcttgcagcccagatgacctgtggtgtggacgagttccgctgcaaggattcgggccgctgcatcccagcgcgttggaagtgtgacggagaggatgactgtggggatggctcggatgagcccaaggaagagtgtggtgagccgagaccccactccaggaggaagacagtctacctgggtgggaggcatggcacccctggcaggtggagggctgggggccgcctgcttaccggtctcagcgtggccctgctgctgggcttcctgggcctgctgtggggctggggaaggaggcctggctggagctcacttccccacatccacccgtgccccatgtctcccagtttccctatccctgcccctgcccacgcctcatccacacatacctgtgtggagttttccctgcccaccctatgggatctgttcatctccttcccaaggcagctgcccacacacacacccccaaccatgtctcctgtccccaaacctccttatagaccccacgtctcaaaacaccgcctgggctccccgcggctgacccttcccaagctgggatgcccaccctccctgccaggccagcctgaccatgcctgcttggaccctaatgtctgccccagccctttccctgactgccctgacacttgcctcctccagatgaacgcacctgtgagccataccagttccgctgcaagaacaaccgctgcgtgcccggccgctggcagtgcgactacgacaacgattgcggtgacaactccgatgaagagagctgcagtacgtccccacccacccagccccgcatgagcccctcccaggcctggcccttgtctcgcggccctcctgccacaggccgcgccagagctggtggccacctcccagggtgggggcaggagccgccctcctcacccatcccactccatgtcgtgtatttgagtttgtgccatttcacctcatctcatgtttctctccattttcacactgtcctctcggggttgcagaggtaggtgtctctgatgtgcccgtgctcccaccatacccccacctctgtcccagagccccccatccctgtgctgtgcctctacccatcatccttgattgacctctccccaaaccctggtgcttgtctcagtggtcttgcccccgctcccctccccaaacacagtctgttctgagggcaaggccagggacctgtgtcctctctggtgtctgtcccatggggtaagtgcgagcccgcctgtgcccagctgttccataggagcagccagtgggctctgccaggactggctcggcctctgggtcagtcagctgtggccttcagagacacggggatgggccttgggctcgggactgtggcactactgaggcctggagtccttgtgcccaccctcctgggcctgtctccccctgtccttcccagcccctcggccctgctccgagagtgagttctcctgtgccaacggccgctgcatcgcggggcgctggaaatgcgatggagaccacgactgcgcggacggctcggacgaggtgggcagggagatgagaaggaagcagatggcctcagaggagttcaggcagggcttggggagtgccgagaggtgaccggctgcctgtgcccatgcccacagaaagactgcaccccccgctgtgacatggaccagttccagtgcaagagcggccactgcatccccctgcgctggcgctgtgacgcagacgccgactgcatggacggcagcgacgaggaggcctgcggcactggcggtgcgccccttggcttggtctccctgggtcctccctctgctgcccaccccgccacatggcccagtcattcactcattctttctcttctgtattcattcttcatgcaacaaatatttattaagcatttaccatgtaccaggcactgccataggtgttagggacgtagtagtaaacaagacacagggcccctgaatacacatttttgtgcgggttgtgcccagctcaatgccccctagtctaggggaccagttgagctgaaatccagcaaaccctgagggctgtgcccatctaggccccaccccacaagtccctccgagacagtctgctgccacaagaagaaaagccctgcctattttcccttcctgggggcagtgagacagtgcctgtccctcgctgacctgcctgggctctgcagtacagagggggcaggtgaagcccgggatgagaaaagactgggccttggagcggaaatcccaactgtgcgggcagatgtcttggctctgccttggtaggccaggcacagggatgggaacccggtcttccattcccagcccagtgctgttcccgcgtccccgctgtggaactacacagcccagtgctgttcccacgtccccgctgtggaactacacagcacagtgccctgccacataccagagaaggagtgccctctgaactcctccagacacccctgaaaaatggcctcttctcccctaaataccagagggggcagtttggccccaccaagtagaaatttaagagacctggttccaatttggctgtgccactgcttgcctggtgacccctctgagcctggaacccccacctgtggagacaggggtctgggtgggctcatggctcattctatctcttggctccccctggcaccagtgcggacctgccccctggacgagttccagtgcaacaacaccttgtgcaagccgctggcctggaagtgcgatggcgaggatgactgtggggacaactcagatgagaaccccgaggagtgtggtgagatttggggcggggctcccaggcttcccagtggccagcaaccacccccactcccaagactaattctggctctgtgtccccctggctgctgcagcccggttcgtgtgccctcccaaccggcccttccgttgcaagaatgaccgcgtctgtctgtggatcgggcgccaatgcgatggcacggacaactgtggggatgggactgatgaagaggactgtggtgagcagggggccgacgagaggcctgcaggggacgggtagtgcacagtggggtgagtctggtcctcgtgggagctgcactggggttagggttaaccaggaggactcgcccaggaaggggaggatccattgctaggagcctgggggcttttcgttaggaaagagaagcccctggggaaggctctgggggctgcctgatgccttaggtcttggaggtggggctgggaacccaaatgtttgacctgctccccctgcaagccttgtcacttaggaattgggagccactgttatctatggggttgccgtgggaggaggaggcaggggagaatacccagggcctaaagcctctgccctcctcagagccccccacagcccacaccacccactgcaaagacaagaaggagtttctgtgccggaaccagcgctgcctctcctcctccctgcgctgcaacatgttcgatgactgcggggacggctctgacgaggaggactgcagcatcggtgaggcccggcagcggaccggacgctggtggggagtggggagagccaagccctggcctggggtggctcaagggagggcatccactctctgtcccccacagaccccaagctgaccagctgcgccaccaatgccagcatctgtggggacgaggcacgctgcgtgcgcaccgagaaagcggcctactgtgcctgccgctcgggcttccacaccgtgcccggccagcccggatgccaaggtaggaaagcggggcagagcaggggtggacaccccaactgtggactctcatgaccctccctgtaacccttagacatcaacgagtgcctgcgcttcggcacctgctcccagctctgcaacaacaccaagggcggccacctctgcagctgcgctcggaacttcatgaagacgcacaacacctgcaaggccgaaggtgccggagccaccagagggcagaaaggctgggtggggcagggcgaccaggatatcaaacggggccgacttggaatggaatgtcttcctgcggacatcttgcccagacaagaagccccagactcatagttgcagctgcctgagcacagtgctggcccagcagtgggggcaggtcctggggctggctgactgaaggagtctggggtgtggcagtgctctgaattgcacacacacctcctcacccaccactgccaggacgagagtacactcagacacgcattgcacactcacagtcatgggggcctcacctgcacattccccacatgctttgatgcccaccttgccttccacatgcctgtacacagacattcacacacacccctggcacacacacccccaccatgcactcccatgcacaccctcgtgctccatgccaagcacacacaccccatgtgcctatgcacccccgagcatgtgccaggcagtttgtagcagagagcgtggtgatgccatccagcagccgtgaggaggtggaagtctctgggtctggaggggcagggacagctttctgactgaaaggagcgggtcacagtggatcagctcaggggaggagaggaggaggtccagaggctgaggttggagcctgcaaccctgagcagggagggtaagcagcagcttctggccggagcagatggtcctaccaggagatgggacagtgttcatgtgaaaggagctgagctgggtggggtgcacacctgcatcccacagccccagccctggcctcttgcttctccaggctctgagtaccaggtcctgtacatcgctgatgacaatgagatccgcagcctgttccccggccacccccattcggcttacgagcaggcattccagggtgacgagagtgtccgcattgatgctatggatgtccatgtcaaggctggccgtgtctattggaccaactggcacacgggcaccatctcctaccgcagcctgccacctgctgcgcctcctaccacttccaaccgccaccggcgacagattgaccggggtgtcacccacctcaacgtgagtgcccaacctggcgtggatggagtggaagagctccatagagcaggcggttcagagcaggatttgaaaagggcagtgctggctaggcgcagtggctcacgcctataatcccagcactttgggaggccaaggcgggcagatcacctgagatcaggagtttgagaccagcgtggcaacatggtgaaaccctgtctctactaaaaatacaaaaatttggctgagcgcggtggctcatgcctgtaatcccagcactttgggaggcagaggtgggtggatcacgaggtcaggagatccagaccaacctggctaacacagtgaaaccccgtctctattaaaaaatacaaaaaaattagccgggcatggtggcgggcgcctgtagtcccagctacttgggaagctggggcaggagaatggcatgaacccgggaggcggagcttgcagtgagccgagatcgcgccactgcactccagcctgggcgagagagtgagactcggtctctaaataaataaataaataaataaataaataaataaataaatagagactcggtctctaaataaataaataaataaataaataaaataaaataaaataaaaatacaaagattagccaggcgtggtggcgggcgcctgtaatcccagctactcaggaggctgaagcaggagaatcctttgaacccagaaggtggaagttgcagtgagccgagtgccactcggttgcagtggcaccaaggttgcagaatagcactgcactccagcctggatgatagagcgagactccgtctcaaaaaaaaaaaaaagaaaaagaaaacaaaagggcagtgcgaggggcaaaggttgagagtggggcagggggcagtcttaggattgtgttctgaggcatggccagcgggaagacagagcagtgggaatggtcagcagctggctgtgctgcaggcagcccagggcacagggcatgatgggcaggcagacagccctccggcaccaatcccccatccttgccacttcccactgtgtacgtcttagctacctcatttaacctctttgggtttcactttgtttatcaataaaattaggtgatcatcgccattgcacaggcttcagggagggctcaccagccacgtgtgagagctgcgagtctggcgcataagctccatgccggttgaatctctttaaagccagggtcctggctgtgagcctggggtgacgttccagcaggctggcagagtggtggcggggggataatggcaggaagacaaagcagtggcccctgaacctgtggcttccattcagatttcagggctgaagatgcccagaggcatcgccatcgactgggtggccggaaacgtgtactggaccgactcgggccgagatgtgattgaggtggcgcagatgaagggcgagaaccgcaagacgctcatctcgggcatgattgacgagccccacgccattgtggtggacccactgagggggtgggcaagggccctggggggaggcctctgggctggtggtaggaagcccccgggacagggttgggggctgcacccacatgcgtgcccttccctcccaggccagcctgaggacagagtccttttcagtcccttgggtcttctcggccacccctgcctggccctccccatgctgcctctgcccagggcccccagctgggcctgcttgggcagggatctgacctctgcttggccggctgtcatgcacagccacactctgccctggggaacagctctgccagcgtcggtggctctgaatgagcacactgtggttttagaggaaaagcccctcaacctgctcagaagcagactcccgcctgcttctctgtagaaggacagaatgccctcctcccagtccccagcagtccctgtccccagaccaagaagctggtgtcctgcctgggcctgcctcctctggccctccggcctgcccacactcaccccttctccctccccaggaccatgtactggtcagactggggcaaccaccccaagattgagacggcagcgatggatgggacgcttcgggagacactggtgcaggacaacattcagtggcccacaggtttgtggggcagggtgcaggagggacgggcatggagggggcccggctcgcagagcccagctgctgctgaagtcacacaaaagcaagggatgggatggggcttggactggggcagggcagattggccgtggaggcttttcccgaaagaggtgactgtgagtggcgtatgaacagggtggagctgtcccgggcatggaggcagttctttccaccccgagcctgggttggggaggccaagctctcacagtgctctctctctccccaggcctggccgtggattatcacaatgagcggctgtactgggcagacgccaagctttcagtcatcggcagcatccggctcaatggcacggaccccattgtggctgctgacagcaaacgaggtcagagcccggcataagtcgcagtccccagccctgtccccagccttgccatcctccctactgagccaaaggcctcacttcaatgcctcccatcctttgtcactgacccccagcaatgctgcagcgccttccaggcctctccagctggcctccccctgaaccagccctgcaggcctgagacccaccctgaccctctggcctacttgtccattcattggttgggttgcacggaggcagcataggtacattaggaacgtagcaaattgggggagaaggaatagaagtcagtcatgactgaccccagaagtctgggggtgatgggaccttttgccagtagtggccacaggaggaggaaccggtgtggggagagagaatttggtctggatgtgttgagtttgaggtgtctgggaaccacaggtgccagtgtcgtggacagcatggccagggcctgagtgcccctcaggtcccctctgactccacctcctcccccaggcctaagtcaccccttcagcatcgacgtctttgaggattacatctatggtgtcacctacatcaataatcgtgtcttcaagatccataagtttggccacagccccttggtcaacctgacagggggcctgagccacgcctctgacgtggtcctttaccatcagcacaagcagcccgaaggtgggggcagaggggagcctgggctggggaagggaggcctgtgggcattgagtctccaagctgtggccctgggacctggtggagagggggtcaccctgggctcacagggctcagagaagggtcctgctcagcatcctccccaccccacccatacctgcagtgaccaacccatgtgaccgcaagaaatgcgagtggctctgcctgctgagccccagtgggcctgtctgcacctgtcccaatgggaagcggctggacaacggcacatgcgtgcctgtgccctctccaacgccccccccagatggtatgcttatgccctcccagtcccagccatgcctcaggaccatctccttcctgtggctcctgacttcccctgaccttgttgcctgtccctctcctcctattcccctggctctgccccttgacgggcccttcctgcagctccccggcctggaacctgtaacctgcagtgcttcaacggtggcagctgtttcctcaatgcacggaggcagcccaagtgccgctgccaaccccgctacacgggtgacaagtgtgaactggaccagtgctgggagcactgtcgcaatgggggcacctgtgctgcctccccctctggtatgccccctcatcccgccacgcctgctccttgcccctgggccccagccccgccacccaccaccccacctcaggcaaatgcccagcccctgcctcgcctccagcctcctttccacaacccagcatccagtcactccagtctctgcttctcgcccaggtccccccagcccattcctctgctatagggccaggtggtctcgagggccacagtcgcgctcacacatcctctcccaccaggcatgcccacgtgccggtgccccacgggcttcacgggccccaaatgcacccagcaggtgtgtgcgggctactgtgccaacaacagcacctgcactgtcaaccagggcaaccagccccagtgccgatgcctacccggcttcctgggcgaccgctgccagtaccgtgagtgagccatccctgggccccagggcatgcgggagggtgacgggggaccccagagcatggggtgatgttcaacctgtgcctgggacccacaggggcaagttcaggaaagaaggccttatgcagctgagccaggcccaagctgctggcgcttccccacaaaggtgctggcacacttcccctgaggcagtgcaccccctgcaccaagattatgcaaacagaaaagctctgttcaacctatggagagccctcatgagggtggggcttgaggcacttctctccctccccaaccacagggcagtgctctggctactgtgagaactttggcacatgccagatggctgctgatggctcccgacaatgccgctgcactgcctactttgagggatcgaggtgtgaggtgaacaagtgcagccgctgtctcgaaggggcctgtgtggtcaacaagcagagtggggatgtcacctgcaagtgagtggggccctcctccacagttccacccagctgggcccctgccctgtcctagccctgccctgcccctcccttcctcagcatcccaggcacgcctctgccagccccagccccagcctctgattccttcctgcagctgcacggatggccgggtggcccccagctgtctgacctgcgtcggccactgcagcaatggcggctcctgtaccatgaacagcaaaatgatgcctgagtgccagtgagttgggcccgggcttcacccaggcatagatcatcgctcccttccccagatttgagcaggaggaccgtcaggcctcagtgcccaccccccgccctgttttcctggcagcagtggctatggaggttatacctactcagccgtgtccctcctttctgcaggtgcccaccccacatgacagggccccggtgtgaggagcacgtcttcagccagcagcagccaggacgtaggtggcaggggttggggcaggcagggccaccgggacctagagcagggggaccgtgtgcctcctgcttccctgagccttggtgactcagtgtcccacctcttccctccagatatagcctccatcctaatccctctgctgttgctgctgctgctggttctggtggccggagtggtattctggtataagcggcgagtccaagggtgagtcacagggattctggaacattctggtcattattttgccatcctagccttcccccccaataatctctgtctccttatactcctgcctttccccagggctaagggcttccagcaccaacggatgaccaacggggccatgaacgtggagattggaaaccccacctacaagatgtacgaaggcggagagcctgatgatgtgggaggcctactggacgctgactttgccctggaccctgacaaggtgggctgggaggcgggcagggtcgagtgccaagaggccgtgggtggcctaaccaaaggtgttgggttaggtgagggacggaggtgggggtggggtaacctgggctacaggcccagctcctgagccctacctgaaccctctgtcaccctgcagcccaccaacttcaccaaccccgtgtatgccacactctacatggggggccatggcagtcgccactccctggccagcacggacgagaagcgagaactcctgggccggggccctgaggacgagataggggaccccttggcatagggccctgccccgtcggactgcccccagaaagcctcctgccccctgccagtgaagtccttcagtgagcccctccccagccagcccttccctggccccgccggatgtataaatgtaaaaatgaaggaattacattttatatgtgagcgagcaagccggcaagcgagcacagtattatttctccatcccctccctgcctgctccttggcacccccatgctgccttcagggagacaggcagggagggcttggggctgcacctcctaccctcccaccagaacgcaccccactgggagagctggtggtgcagccttcccctccctgtataagacactttgccaaggctctcccctctcgccccatccctgcttgcccgctcccacagcttcctgagggctaattctgggaagggagagttctttgctgcccctgtctggaagacgtggctctgggtgaggtaggcgggaaaggatggagtgttttagttcttgggggaggccaccccaaaccccagccccaactccaggggcacctatgagatggccatgctcaacccccctcccagacaggccctccctgtctccagggcccccaccgaggttcccagggctggagacttcctctggtaaacattcctccagcctcccctcccctggggacgccaaggaggtgggccacacccaggaagggaaagcgggcagccccgttttggggacgtgaacgttttaataatttttgctgaattcctttacaactaaataacacagatattgttataaataaaattgtaa

SEQ ID NO: 409 - DNA, 5364 bp, Homo sapiens
cataaagaaaaaagcggtgagtgggcgaactacaattcccaaaaggccacaaaggggccaccactacgcatgcgtagatccctcccgttagctttggcgcctcagcgagctcttctcgcgcatgcgttctccgaacggtcttcttccgacagcttgctgccctagaccagagttggtggctggacctcctgcgacttccgagttgcgatgctgtacttctctttgttttgggcggctcgggtaagaatggggctccaaacgctgggtaatcagtggaaaggaagctcttctcctaccttagttcctagtcacaaactctggggttctcttggcttttccatgcacgtggattggggcctcagggagcggacgtgtaactggggaatccccaagacccctgggcgcgcgtggagttaactgcgagcctgtcctcattctggcgatcagacgccccagggcctcgtgaccgcccatttcacgtggcattaggggagaggacagccccggatgccccgcggacccggtgctggcaaatgagcggagttttcggcctggtctcacaagctgagcctttccggccagctctgagccctgcagatgatgcaaccgagcttcactgcttgcatcaggcaggggtcccggcggcagtgagggctggaaggaggtggaacgggtagggggctaagtaaggggaaagggtattggcttactctcgggcagatccccacccccaccactcccacacagctcttcctcacggactgctaaaggtctcccctcccacctgcattgctctacaatctgtggcctcagcccttgccaactctgcctcttcccccgctgactggggtatcagtttatggtgccctgcaggaagaccctcttgttcctgtgggtgggaaggttctggaatctcagttgccctctctggagttggggagacataggcttttggaggacaagctttgcagagtggttcatggagtgaggtggtgggagatttctgaggtgcggtgcggtgaatggagcaaatcagaaccaccccttggacgttgatctcaagcttggctccagaactggcttttgaaggtggaggtgggggtagtgagaactgaaacaggctggctggacaactggcagcttggtgtggccttagaagcatgagtgagggtggccgggagacgatttgtctggactgttgtgatttcaccctgacttttcctgccttcagcctctgcagagatgtgggcagctggtcaggatggccattcgggctcagcacagcaacgcagcccagactcagactggggaagcaaacaggggctggacaggccaggagagcctgtcggacagtgatcctgagatgtgggagttgctgcagagggagaaggacaggcagtgtcgtggcctggagctcattgcctcagaggtgggacctggggagatgggcaggggttgggccaccatgggtacaggaagtaacaaagttatcttaactgatatttctccaaaaccccctttcacactcaggacctttctttgggctttatcttcctttcttatctccctcaagcaaaggcagtgcaagtccagtttatggggttgggacatttagggagcctccagggtccctacagtttcatctgatcccttccttccttcctcctatgaggaaggaggagcctagaagcacaagtttgagtgggtaggtggcattgaggggccactgctcatggcagatgggtttctgagaatgctgcctctggctttgccccaggcctggtgctgagtgaatggagctttctgcagggagtactcccgctttcagctctggctctggcagggagggactgtgggagtccaggggaaggggctcaataccttctgacattgccccccaccaccccagaacttctgcagccgagctgcgctggaggccctggggtcctgtctgaacaacaagtactcggagggttatcctggcaagaggtgagggctggagggcagtgtcagggatggtgctcccagtgggggaacccacctgtaccttcccagtgttcattgaggagtgaacttcccagtcctttgctgatggttgagagtcctttctctgtgccctcattacccctctcccacggcagatactatgggggagcagaggtggtggatgaaattgagctgctgtgccagcgccgggccttggaagcctttgacctggatcctgcacagtggggagtcaatgtccagccctactccgggtccccagccaacctggccgtctacacagcccttctgcaacctcacgaccggatcatggggctggacctgcccgatgggggccagtgagtatggatgggctggctgatggtcttggcggcaggattggtgtgggaaaggagttatttattgaatacctactgtggaccatacagatggaacaggccttgccctgtcctgcatgtcacagtggatgaggaagataagatcccagttatagtgcctaccacagagtggacagagcagtgaggcggtgtgtcctaggactggtgttctggggacagagaactgtggagttgaagggagtggttaagtccgggggtccttccacccaggccttcttacttcctctcacttcgcagtctcacccacggctacatgtctgacgtcaagcggatatcagccacgtccatcttcttcgagtctatgccctataagctcaacgtgagtgctctagggtgtggggaggggctcttggccctggtggtggtcctcccctggagaagctgagggcctggagcgccgggccgtccttagggttaaggaggagagtgagctgccctgcttccttctcagggctttagctgtttgtgtgtctgtccagcccaaaactggcctcattgactacaaccagctggcactgactgctcgacttttccggccacggctcatcatagctggcaccagcgcctatgctcgcctcattgactacgcccgcatgagagaggttggtggggggggctggagactgggcacctccccagggggtggtgaggaggtgtgggaggagggcagccttgggcaggcctctccgggccctccccaggctgaggccttgcctctgtacctgcccaggtgtgtgatgaagtcaaagcacacctgctggcagacatggcccacatcagtggcctggtggctgccaaggtgattccctcgcctttcaagcacgcggacatcgtcaccaccactactcacaagactcttcgaggggccaggtcaggctccctgaggtcgggccttgcctttccctgccttcaggcctattcctggggcactgttggcctggacctgagaggaattcattcccacctgcagcccttaagactcctgcccagtctgtgagagttctccttctcttgcccatggtggccatgccctggcaggggatttgtggatgggattgaggggctgattccctctaccactggaatccagtgtaccaagcccacgtgagctgtgcccttggggcccaggtccgccagcttcctctgccttctctgtcccttgtccttcttttcagcttagactctgaccatccacctctcacacaggtcagggctcatcttctaccggaaaggggtgaaggctgtggaccccaagactggccgggagatcccttacacatttgaggaccgaatcaactttgccgtgttcccatccctgcaggggggcccccacaatcatgccattgctgcagtagctgtggccctaaagcaggttggggatcctgtctttgtagggtgtgggggggcaatggcctggaggcttagaccctgcaccttgctaactgatgctggggctgatggaagggaaatgccaggatggaaggagtcaaggctggggtcacagagctatgctgagggtgcagggccagagggtagtgcagggcttgggtccaggcctagggtgacagctgctactgtctcatctccaggcctgcacccccatgttccgggagtactccctgcaggttctgaagaatgctcgggccatggcagatgccctgctagagcgaggctactcactggtatcaggtaagccagcaggtgatgggtgagggcctctgtagcttcaggcagaggcccaggactcaccactccccatttcttacccaccttaggtggtactgacaaccacctggtgctggtggacctgcggcccaagggcctggatggagctcgggctgagcgggtgctagagcttgtatccatcactgccaacaagaacacctgtcctggagaccgaagtgccatcacaccgggcggcctgcggcttggtgagacctggggtttgaggagggaaggggctcccatgctggatgactgccaggtgaccttgggctatgctcatccctccccttgtgcctcgttccaggggccccagccttaacttctcgacagttccgtgaggatgacttccggagagttgtggactttatagatgaaggggtcaacattggcttagaggtgaagagcaagactggtgagtgagcaagaaggagccccgggccagccagttcccactcactgtctgctccctcccccagctgatctcactgccttccctagagctctgaccacttgtttcctcaccctctctctctagccaagctccaggatttcaaatccttcctgcttaaggactcagaaacaagtcagcgtctggccaacctcaggcaacgggtggagcagtttgccagggccttccccatgcctggttttgatgagcattgaaggcacctgggaaatgaggcccacagactcaaagttactctccttccccctacctgggccagtgaaatagaaagcctttctattttttggtgcgggagggaagacctctcacttagggcaagagccaggtatagtctcccttcccagaatttgtaactgagaagatcttttctttttcctttttttggtaacaagacttagaaggagggcccaggcactttctgtttgaacccctgtcatgatcacagtgtcagagacgcgtcctctttcttggggaagttgaggagtgcccttcagagccagtagcaggcaggggtgggtaggcaccctccttcctgtttttatctaataaaatgctaacctgccctgagtttccattactgtgggtggggttcccctgggccaaacagtgatttgtctccctcaatgtgtacaccgctccgctcccaccaccgctaccacaaggacccccggggctgcagcctcctctttctgtctctgatcagagccgacaccagacgtgattagcaggcgcagcaaattcaatttgttaaatgaaattgtattttgccca

SEQ ID NO: 410 - DNA, 5791 bp, Homo sapiens
attcaatttgttaaatgaaattgtattttgcccacggctgcttctgtttgatccctggggacagaggggagcaagggaggggagtggcagggggaggcccaggtgtggggctggagggggtactggcggcagcgggaggcagtaggcttgggcaggggaggagtgcgctgcgcctcaggaggcaaaggtgccccagcctgggcaggccctggaccagcccaagctgagcagcgccgcccctgggctggctctcagagcctgggctaacgtggagcccgccacgtcgcttggcactcagaggcccctgcttcttgttggctcacgtaggccacgctcaacacgtagcctgtgccacacccttcgaggcccgggtaggagggcagaggggctggtctgggctcttggtggacccctgctggtgctgcctgcctcctcctcccccacgtgggactcaagccaagggtcagaggcgcttccgctgctgggagcaagggaggagagtaggggtggagcagcctcccctctgcgtgggaacccggcctgtgtaagcagtagcgggacagggtggccggagtgatgccttggggcctgcggggaggagtggaagaagtggatgggctggctggctgtggcttgcatggcactggcagcccagcctggcttagaagtctggccggtccttcttcagcttcttatagtcagtggaaactgcaaggaactaagaggagagggaaagggggttgcgctgagtaccccaagcctccctttgcttctagtacgggagttgtgggtgccaggaccaggagataagaggatggggggcaaccctagagccatcgagaggtaccttgtattggtcattggggctcaggcggttccagggctccgggttgttctttctgtcccagctgtggagcaggaggggggagggttagggtctcctccctgggacccagaactctgtaacccaatttgacccccaagctccacccggaggctctggccccaccccagtacccctgcctcctgccctgggggtcccatttcccagatactgacaaaggaacggtcatattagcaggtgctgacaagtgagacaagaagcctgtcaccattgtcagcatggggctgcgtgacaaactgacaacggggcccagggactcccacttgctgcctgccaccctaggttaaccctaagagcagagtcgtgggaatcagacacagatcccaaggggctgggtttctggtgatgtgccgggaattataaagccatgggtgcgcctttcacttccggaccctctccgcggccgggtgtgaaatctccgccccacactggtccccaatgccacccccagcagctcacccggccacaaccccagtgctctggtgaggacttagaggtacccaaaagcccaagcccaccgctggctgagcggcgtcgtcatggcaacccggccgggagaggcgcgggttccgcatttcagggcgggccaagctgaggagtgagcggccaggtgggctggaggggatacgggggtctcccaggtcagcagtgggctccagccctgagatgccggtcggtacagtcgaaggtgcatgcagcagggcacgggatccccactagggccgcctatttccaccccatcttgcctcacccaggcccccgtgagcatcccaagccgtgcctttaccagacgtcggggctgcgaagggcgagtcgcagcaagtaaagcgcagcgctgcccatgcccaggcagattaagccgatcatcgggatgatctgcggggaagagggagagcacttttggggtcagccctctccccgcagttcccagtcaccctttacaagcttttctgcccaccccaaccccaccccgggtctggtgctccctccctggaatctcctacaaccatatttcctggcatggtctccctcaccctacagcgatcgtgtccaaggtagtagatttgtgggacacagggacgtttcggagagagactggggcaaccttaggggaagaataggagcgctgagggacctgggcacaaggcaaggcattgggggatttggagggtggggcagcaggagagttaggagttagaggttctgaggttctgaggactcacccccggatgtcttttgatctgccggtagaagcgggccccaagactggctcctgccatatcgttgttttcccagtctggtcctctgcagtggctctgtcctctccctcctcctggggtcccgcccctgagtggggagggatcagcccagcccagagcagcttagcttggcccagcccgtgcttctttggactcaccccaccccaacttagctcactttctcctcaattccaggcccaaagcctgtaggggaattgtctgggagccaagtggtttctgctctccgactctctcctccagatgtctgcacctggaccaagggacaccatcattcttggggcttctggcatctgagggaaggacctcagtggcataggaccccataagatgtgggaggaggcatggccatgggacaggcacttagcaaaatgcatgtgtggaatgttcacaggtgggaccaggaggggctaaggccagtgagggcatgtgcagcacttccctgacacccttagagctgtccaggagcgggtcctgagaaccctggttctgtcccctccacagtgtagtgggggaaggaggaagacaggcccacaccgtaaagctcccccagcccctcttgttctgagtggtttcttcaggttgtggttggactggaattgcggttggaggctggaagaaccaggtgtatgttaatcatggctcaggatagaatacgccagtttatttattctaccacagtcatggcagtgaggcttgagagacttgcttgctctgcctacctggggtagggtaaaggtggggccgcccaaggaggccatccacttcctctggctgtgggatggataggaagggaatggagtgggggaaacaggaaagatcggacagatgctgaaagagaacaagacacagacacagaaatgcaagcgattccctcctgtcctcaaccatctcaggtgtgtgctgtgctgctggggtggggaggctcacagcccccgtctctggggaatttgggtcttagggacgtaggaaccgagtcctaatatctctccccactcccacgataacctccaccaccccctccctcctcgcagccgatcctgcagagcacctccccctccagagcccgccctgtggagggcgcgggcgggagcgagctatgcacccgtctctgggatcgtcggggtacagggagggagagggcgctttctagggtccgcctccctttccttctcgctgatacttccgccgccccctactctgacaagcgcggctgtaattaggctgcggggtcccgggctctccgcctcactccggcggataatgagataaagtgtcagagacacggcgagaacaaagagacagagactcgctgcgatgtgtgtggggggggcgggggagcggggctgacgggctgttagagcctccagcagcccagccctcccgagagcccgcgcctccagggcccaggaagggagggcgtgtcctgtcacccgcgcaccccagccctccagtctctgggaccaaaaaacaatcccagagctcaaactcgagcggccgcacaactgggctgcacatctggttctctgtggcacagctggggagccaggacgccggaaggggcgcctggtccttgcgcctttgctcacaggccctcgcctgcttccttgtgccctttgttctgagttccggtgaccccggccaggtcccaaattctccgtcgcgctccttttccagagccgccgctgtccctccggccttgggcctccgccccgctcaccgagatgcaacgttacattattgcctccgctccgcctctccgccactctctgacccttctcctgcttctggtccctgtctctgtgaatttatttctaagcccccttccatctttggttcccgtctctggctcgtggcccatggggccgatctggaatacaggactccttgggttccggatcccatctctcctcgctccccacactttcccaccacgaggactcaggccacgctggcccagcggggtgagggaccgcaggagtcattagccgcagattaggcacggcccgggatcccgctgggactggactccaagcgctaacccgcaccaggatcccaatccgcgcgctggctgcacagagggtcaaaggcagcgggactcagcggatcgagcgtgttgcaggggccgtgggctcgggcgccccctggaggccgagcggcccccaagctcggggaagaggccttgggcaccccctgtcgggcagtgtcgaccctgcactcccggcgttcgggccgctaagttggtgcctggagtgtccgtccacgcccagcccgtcactccgccactcccgcctccaagacagtgggtcctgcagcctccactcttctggtgtgagatgggaccggagggcggagaggggacgcggaagctcctatctctccagccacaatcggcacccagggttcaggcgggttcctcttctggggttgggcatcctcagatgcctgggggccggggaggcgggggcttcatctctgcttctgggctgcagattcgagattgccctaagccctctgacccggcctgtcctagcctctggctgcccttctttctgcctcttgttctttctgccttctgtctgcttcctgtctctgggtatgtccatctctctcttccctattctggctgtgtctgtctgctctccctcttgctgccttccctacctggctttgtccctctgcatcggtttttctgtgtctctttgtgtctcgctccctccctccacatctctccatctcactgtgtctctctttactaatgcctctctttgtctctgtctttatctctgtctctccccaaccccactccccagctctattcctattctctgggttgctgcctctggggactgaagcagcccaacagggcagcccggagacgcctcggggcactgcccggggtcctcatcctggtcacctccacatgcccgtcaactccgcgcagcgttgatcttcccgctgcggctgtgggacgtggaggggcgcccggaaaggaagacacagggcccagcatctgctcgggagccccggggcccctgacccccctctgccattattaagggcgcctggtcccgaggcaccgagatgatcatgattgcatcagccagacagaagcggagccgggagctgcgcggtgagcgaacgagtgagacaaagccgcccgcgccatctgtttatgcaaagcgctctccgccggggaccccggcgtcccggctcctggccgggcttggggcaagggtcataagcccattcccacccggcgcccccaccgcgccttggcttcccctctcctcagcacccagagggccgctgggcgagcggaacggaaagggggcgggggtgttgatgtgattggagcggacgcggctgtttcttcaataatggatggagatgatgcggatggcgaagccgagctggccgggagaggagagaggaatagaaatggggaaaggaaggagtgggggcgggagactcaccccggcgcgcgcacacacacactcgcgcgcgcacgtgcgtcacactgtcattcggatacacgccgccgcgcggctcacacccaggcacacgcctacgcactgtcactgagacacacatacctgcaggcggagac

SEQ ID NO: 411 - DNA, 4892 bp, Homo sapiens
atttcacgtggcattaggggagaggacagccccggatgccccgcggacccggtgctggcaaatgagcggagttttcggcctggtctcacaagctgagcctttccggccagctctgagccctgcagatgatgcaaccgagcttcactgcttgcatcaggcaggggtcccggcggcagtgagggctggaaggaggtggaacgggtagggggctaagtaaggggaaagggtattggcttactctcgggcagatccccacccccaccactcccacacagctcttcctcacggactgctaaaggtctcccctcccacctgcattgctctacaatctgtggcctcagcccttgccaactctgcctcttcccccgctgactggggtatcagtttatggtgccctgcaggaagaccctcttgttcctgtgggtgggaaggttctggaatctcagttgccctctctggagttggggagacataggcttttggaggacaagctttgcagagtggttcatggagtgaggtggtgggagatttctgaggtgcggtgcggtgaatggagcaaatcagaaccaccccttggacgttgatctcaagcttggctccagaactggcttttgaaggtggaggtgggggtagtgagaactgaaacaggctggctggacaactggcagcttggtgtggccttagaagcatgagtgagggtggccgggagacgatttgtctggactgttgtgatttcaccctgacttttcctgccttcagcctctgcagagatgtgggcagctggtcaggatggccattcgggctcagcacagcaacgcagcccagactcagactggggaagcaaacaggggctggacaggccaggagagcctgtcggacagtgatcctgagatgtgggagttgctgcagagggagaaggacaggcagtgtcgtggcctggagctcattgcctcagaggtgggacctggggagatgggcaggggttgggccaccatgggtacaggaagtaacaaagttatcttaactgatatttctccaaaaccccctttcacactcaggacctttctttgggctttatcttcctttcttatctccctcaagcaaaggcagtgcaagtccagtttatggggttgggacatttagggagcctccagggtccctacagtttcatctgatcccttccttccttcctcctatgaggaaggaggagcctagaagcacaagtttgagtgggtaggtggcattgaggggccactgctcatggcagatgggtttctgagaatgctgcctctggctttgccccaggcctggtgctgagtgaatggagctttctgcagggagtactcccgctttcagctctggctctggcagggagggactgtgggagtccaggggaaggggctcaataccttctgacattgccccccaccaccccagaacttctgcagccgagctgcgctggaggccctggggtcctgtctgaacaacaagtactcggagggttatcctggcaagaggtgagggctggagggcagtgtcagggatggtgctcccagtgggggaacccacctgtaccttcccagtgttcattgaggagtgaacttcccagtcctttgctgatggttgagagtcctttctctgtgccctcattacccctctcccacggcagatactatgggggagcagaggtggtggatgaaattgagctgctgtgccagcgccgggccttggaagcctttgacctggatcctgcacagtggggagtcaatgtccagccctactccgggtccccagccaacctggccgtctacacagcccttctgcaacctcacgaccggatcatggggctggacctgcccgatgggggccagtgagtatggatgggctggctgatggtcttggcggcaggattggtgtgggaaaggagttatttattgaatacctactgtggaccatacagatggaacaggccttgccctgtcctgcatgtcacagtggatgaggaagataagatcccagttatagtgcctaccacagagtggacagagcagtgaggcggtgtgtcctaggactggtgttctggggacagagaactgtggagttgaagggagtggttaagtccgggggtccttccacccaggccttcttacttcctctcacttcgcagtctcacccacggctacatgtctgacgtcaagcggatatcagccacgtccatcttcttcgagtctatgccctataagctcaacgtgagtgctctagggtgtggggaggggctcttggccctggtggtggtcctcccctggagaagctgagggcctggagcgccgggccgtccttagggttaaggaggagagtgagctgccctgcttccttctcagggctttagctgtttgtgtgtctgtccagcccaaaactggcctcattgactacaaccagctggcactgactgctcgacttttccggccacggctcatcatagctggcaccagcgcctatgctcgcctcattgactacgcccgcatgagagaggttggtggggggggctggagactgggcacctccccagggggtggtgaggaggtgtgggaggagggcagccttgggcaggcctctccgggccctccccaggctgaggccttgcctctgtacctgcccaggtgtgtgatgaagtcaaagcacacctgctggcagacatggcccacatcagtggcctggtggctgccaaggtgattccctcgcctttcaagcacgcggacatcgtcaccaccactactcacaagactcttcgaggggccaggtcaggctccctgaggtcgggccttgcctttccctgccttcaggcctattcctggggcactgttggcctggacctgagaggaattcattcccacctgcagcccttaagactcctgcccagtctgtgagagttctccttctcttgcccatggtggccatgccctggcaggggatttgtggatgggattgaggggctgattccctctaccactggaatccagtgtaccaagcccacgtgagctgtgcccttggggcccaggtccgccagcttcctctgccttctctgtcccttgtccttcttttcagcttagactctgaccatccacctctcacacaggtcagggctcatcttctaccggaaaggggtgaaggctgtggaccccaagactggccgggagatcccttacacatttgaggaccgaatcaactttgccgtgttcccatccctgcaggggggcccccacaatcatgccattgctgcagtagctgtggccctaaagcaggttggggatcctgtctttgtagggtgtgggggggcaatggcctggaggcttagaccctgcaccttgctaactgatgctggggctgatggaagggaaatgccaggatggaaggagtcaaggctggggtcacagagctatgctgagggtgcagggccagagggtagtgcagggcttgggtccaggcctagggtgacagctgctactgtctcatctccaggcctgcacccccatgttccgggagtactccctgcaggttctgaagaatgctcgggccatggcagatgccctgctagagcgaggctactcactggtatcaggtaagccagcaggtgatgggtgagggcctctgtagcttcaggcagaggcccaggactcaccactccccatttcttacccaccttaggtggtactgacaaccacctggtgctggtggacctgcggcccaagggcctggatggagctcgggctgagcgggtgctagagcttgtatccatcactgccaacaagaacacctgtcctggagaccgaagtgccatcacaccgggcggcctgcggcttggtgagacctggggtttgaggagggaaggggctcccatgctggatgactgccaggtgaccttgggctatgctcatccctccccttgtgcctcgttccaggggccccagccttaacttctcgacagttccgtgaggatgacttccggagagttgtggactttatagatgaaggggtcaacattggcttagaggtgaagagcaagactggtgagtgagcaagaaggagccccgggccagccagttcccactcactgtctgctccctcccccagctgatctcactgccttccctagagctctgaccacttgtttcctcaccctctctctctagccaagctccaggatttcaaatccttcctgcttaaggactcagaaacaagtcagcgtctggccaacctcaggcaacgggtggagcagtttgccagggccttccccatgcctggttttgatgagcattgaaggcacctgggaaatgaggcccacagactcaaagttactctccttccccctacctgggccagtgaaatagaaagcctttctattttttggtgcgggagggaagacctctcacttagggcaagagccaggtatagtctcccttcccagaatttgtaactgagaagatcttttctttttcctttttttggtaacaagacttagaaggagggcccaggcactttctgtttgaacccctgtcatgatcacagtgtcagagacgcgtcctctttcttggggaagttgaggagtgcccttcagagccagtagcaggcaggggtgggtaggcaccctccttcctgtttttatctaataaaatgctaacctgccctgagtttccattactgtgggtggggttcccctgggccaaacagtgatttgtctccctcaatgtgtacaccgctccgctcccaccaccgctaccacaaggacccccggggctgcagcctcctctttctgtctctgatcagagccgacaccagacgtgattagcaggcgcagcaaattcaatttgttaaatgaaattgtattttgccca

SEQ ID NO: 412 - DNA, 4609 bp, Homo sapiens
cacggactgctaaaggtctcccctcccacctgcattgctctacaatctgtggcctcagcccttgccaactctgcctcttcccccgctgactggggtatcagtttatggtgccctgcaggaagaccctcttgttcctgtgggtgggaaggttctggaatctcagttgccctctctggagttggggagacataggcttttggaggacaagctttgcagagtggttcatggagtgaggtggtgggagatttctgaggtgcggtgcggtgaatggagcaaatcagaaccaccccttggacgttgatctcaagcttggctccagaactggcttttgaaggtggaggtgggggtagtgagaactgaaacaggctggctggacaactggcagcttggtgtggccttagaagcatgagtgagggtggccgggagacgatttgtctggactgttgtgatttcaccctgacttttcctgccttcagcctctgcagagatgtgggcagctggtcaggatggccattcgggctcagcacagcaacgcagcccagactcagactggggaagcaaacaggggctggacaggccaggagagcctgtcggacagtgatcctgagatgtgggagttgctgcagagggagaaggacaggcagtgtcgtggcctggagctcattgcctcagaggtgggacctggggagatgggcaggggttgggccaccatgggtacaggaagtaacaaagttatcttaactgatatttctccaaaaccccctttcacactcaggacctttctttgggctttatcttcctttcttatctccctcaagcaaaggcagtgcaagtccagtttatggggttgggacatttagggagcctccagggtccctacagtttcatctgatcccttccttccttcctcctatgaggaaggaggagcctagaagcacaagtttgagtgggtaggtggcattgaggggccactgctcatggcagatgggtttctgagaatgctgcctctggctttgccccaggcctggtgctgagtgaatggagctttctgcagggagtactcccgctttcagctctggctctggcagggagggactgtgggagtccaggggaaggggctcaataccttctgacattgccccccaccaccccagaacttctgcagccgagctgcgctggaggccctggggtcctgtctgaacaacaagtactcggagggttatcctggcaagaggtgagggctggagggcagtgtcagggatggtgctcccagtgggggaacccacctgtaccttcccagtgttcattgaggagtgaacttcccagtcctttgctgatggttgagagtcctttctctgtgccctcattacccctctcccacggcagatactatgggggagcagaggtggtggatgaaattgagctgctgtgccagcgccgggccttggaagcctttgacctggatcctgcacagtggggagtcaatgtccagccctactccgggtccccagccaacctggccgtctacacagcccttctgcaacctcacgaccggatcatggggctggacctgcccgatgggggccagtgagtatggatgggctggctgatggtcttggcggcaggattggtgtgggaaaggagttatttattgaatacctactgtggaccatacagatggaacaggccttgccctgtcctgcatgtcacagtggatgaggaagataagatcccagttatagtgcctaccacagagtggacagagcagtgaggcggtgtgtcctaggactggtgttctggggacagagaactgtggagttgaagggagtggttaagtccgggggtccttccacccaggccttcttacttcctctcacttcgcagtctcacccacggctacatgtctgacgtcaagcggatatcagccacgtccatcttcttcgagtctatgccctataagctcaacgtgagtgctctagggtgtggggaggggctcttggccctggtggtggtcctcccctggagaagctgagggcctggagcgccgggccgtccttagggttaaggaggagagtgagctgccctgcttccttctcagggctttagctgtttgtgtgtctgtccagcccaaaactggcctcattgactacaaccagctggcactgactgctcgacttttccggccacggctcatcatagctggcaccagcgcctatgctcgcctcattgactacgcccgcatgagagaggttggtggggggggctggagactgggcacctccccagggggtggtgaggaggtgtgggaggagggcagccttgggcaggcctctccgggccctccccaggctgaggccttgcctctgtacctgcccaggtgtgtgatgaagtcaaagcacacctgctggcagacatggcccacatcagtggcctggtggctgccaaggtgattccctcgcctttcaagcacgcggacatcgtcaccaccactactcacaagactcttcgaggggccaggtcaggctccctgaggtcgggccttgcctttccctgccttcaggcctattcctggggcactgttggcctggacctgagaggaattcattcccacctgcagcccttaagactcctgcccagtctgtgagagttctccttctcttgcccatggtggccatgccctggcaggggatttgtggatgggattgaggggctgattccctctaccactggaatccagtgtaccaagcccacgtgagctgtgcccttggggcccaggtccgccagcttcctctgccttctctgtcccttgtccttcttttcagcttagactctgaccatccacctctcacacaggtcagggctcatcttctaccggaaaggggtgaaggctgtggaccccaagactggccgggagatcccttacacatttgaggaccgaatcaactttgccgtgttcccatccctgcaggggggcccccacaatcatgccattgctgcagtagctgtggccctaaagcaggttggggatcctgtctttgtagggtgtgggggggcaatggcctggaggcttagaccctgcaccttgctaactgatgctggggctgatggaagggaaatgccaggatggaaggagtcaaggctggggtcacagagctatgctgagggtgcagggccagagggtagtgcagggcttgggtccaggcctagggtgacagctgctactgtctcatctccaggcctgcacccccatgttccgggagtactccctgcaggttctgaagaatgctcgggccatggcagatgccctgctagagcgaggctactcactggtatcaggtaagccagcaggtgatgggtgagggcctctgtagcttcaggcagaggcccaggactcaccactccccatttcttacccaccttaggtggtactgacaaccacctggtgctggtggacctgcggcccaagggcctggatggagctcgggctgagcgggtgctagagcttgtatccatcactgccaacaagaacacctgtcctggagaccgaagtgccatcacaccgggcggcctgcggcttggtgagacctggggtttgaggagggaaggggctcccatgctggatgactgccaggtgaccttgggctatgctcatccctccccttgtgcctcgttccaggggccccagccttaacttctcgacagttccgtgaggatgacttccggagagttgtggactttatagatgaaggggtcaacattggcttagaggtgaagagcaagactggtgagtgagcaagaaggagccccgggccagccagttcccactcactgtctgctccctcccccagctgatctcactgccttccctagagctctgaccacttgtttcctcaccctctctctctagccaagctccaggatttcaaatccttcctgcttaaggactcagaaacaagtcagcgtctggccaacctcaggcaacgggtggagcagtttgccagggccttccccatgcctggttttgatgagcattgaaggcacctgggaaatgaggcccacagactcaaagttactctccttccccctacctgggccagtgaaatagaaagcctttctattttttggtgcgggagggaagacctctcacttagggcaagagccaggtatagtctcccttcccagaatttgtaactgagaagatcttttctttttcctttttttggtaacaagacttagaaggagggcccaggcactttctgtttgaacccctgtcatgatcacagtgtcagagacgcgtcctctttcttggggaagttgaggagtgcccttcagagccagtagcaggcaggggtgggtaggcaccctccttcctgtttttatctaataaaatgctaacctgccctgagtttccattactgtgggtggggttcccctgggccaaacagtgatttgtctccctcaatgtgtacaccgctccgctcccaccaccgctaccacaaggacccccggggctgcagcctcctctttctgtctctgatcagagccgacaccagacgtgattagcaggcgcagcaaattcaatttgttaaatgaaattgtattttgccca

SEQ ID NO: 413 - DNA, 4892 bp, Homo sapiens; identical to SEQ ID NO: 411

SEQ ID NO: 414 - DNA, 4577 bp, Homo sapiens
cattgctctacaatctgtggcctcagcccttgccaactctgcctcttcccccgctgactggggtatcagtttatggtgccctgcaggaagaccctcttgttcctgtgggtgggaaggttctggaatctcagttgccctctctggagttggggagacataggcttttggaggacaagctttgcagagtggttcatggagtgaggtggtgggagatttctgaggtgcggtgcggtgaatggagcaaatcagaaccaccccttggacgttgatctcaagcttggctccagaactggcttttgaaggtggaggtgggggtagtgagaactgaaacaggctggctggacaactggcagcttggtgtggccttagaagcatgagtgagggtggccgggagacgatttgtctggactgttgtgatttcaccctgacttttcctgccttcagcctctgcagagatgtgggcagctggtcaggatggccattcgggctcagcacagcaacgcagcccagactcagactggggaagcaaacaggggctggacaggccaggagagcctgtcggacagtgatcctgagatgtgggagttgctgcagagggagaaggacaggcagtgtcgtggcctggagctcattgcctcagaggtgggacctggggagatgggcaggggttgggccaccatgggtacaggaagtaacaaagttatcttaactgatatttctccaaaaccccctttcacactcaggacctttctttgggctttatcttcctttcttatctccctcaagcaaaggcagtgcaagtccagtttatggggttgggacatttagggagcctccagggtccctacagtttcatctgatcccttccttccttcctcctatgaggaaggaggagcctagaagcacaagtttgagtgggtaggtggcattgaggggccactgctcatggcagatgggtttctgagaatgctgcctctggctttgccccaggcctggtgctgagtgaatggagctttctgcagggagtactcccgctttcagctctggctctggcagggagggactgtgggagtccaggggaaggggctcaataccttctgacattgccccccaccaccccagaacttctgcagccgagctgcgctggaggccctggggtcctgtctgaacaacaagtactcggagggttatcctggcaagaggtgagggctggagggcagtgtcagggatggtgctcccagtgggggaacccacctgtaccttcccagtgttcattgaggagtgaacttcccagtcctttgctgatggttgagagtcctttctctgtgccctcattacccctctcccacggcagatactatgggggagcagaggtggtggatgaaattgagctgctgtgccagcgccgggccttggaagcctttgacctggatcctgcacagtggggagtcaatgtccagccctactccgggtccccagccaacctggccgtctacacagcccttctgcaacctcacgaccggatcatggggctggacctgcccgatgggggccagtgagtatggatgggctggctgatggtcttggcggcaggattggtgtgggaaaggagttatttattgaatacctactgtggaccatacagatggaacaggccttgccctgtcctgcatgtcacagtggatgaggaagataagatcccagttatagtgcctaccacagagtggacagagcagtgaggcggtgtgtcctaggactggtgttctggggacagagaactgtggagttgaagggagtggttaagtccgggggtccttccacccaggccttcttacttcctctcacttcgcagtctcacccacggctacatgtctgacgtcaagcggatatcagccacgtccatcttcttcgagtctatgccctataagctcaacgtgagtgctctagggtgtggggaggggctcttggccctggtggtggtcctcccctggagaagctgagggcctggagcgccgggccgtccttagggttaaggaggagagtgagctgccctgcttccttctcagggctttagctgtttgtgtgtctgtccagcccaaaactggcctcattgactacaaccagctggcactgactgctcgacttttccggccacggctcatcatagctggcaccagcgcctatgctcgcctcattgactacgcccgcatgagagaggttggtggggggggctggagactgggcacctccccagggggtggtgaggaggtgtgggaggagggcagccttgggcaggcctctccgggccctccccaggctgaggccttgcctctgtacctgcccaggtgtgtgatgaagtcaaagcacacctgctggcagacatggcccacatcagtggcctggtggctgccaaggtgattccctcgcctttcaagcacgcggacatcgtcaccaccactactcacaagactcttcgaggggccaggtcaggctccctgaggtcgggccttgcctttccctgccttcaggcctattcctggggcactgttggcctggacctgagaggaattcattcccacctgcagcccttaagactcctgcccagtctgtgagagttctccttctcttgcccatggtggccatgccctggcaggggatttgtggatgggattgaggggctgattccctctaccactggaatccagtgtaccaagcccacgtgagctgtgcccttggggcccaggtccgccagcttcctctgccttctctgtcccttgtccttcttttcagcttagactctgaccatccacctctcacacaggtcagggctcatcttctaccggaaaggggtgaaggctgtggaccccaagactggccgggagatcccttacacatttgaggaccgaatcaactttgccgtgttcccatccctgcaggggggcccccacaatcatgccattgctgcagtagctgtggccctaaagcaggttggggatcctgtctttgtagggtgtgggggggcaatggcctggaggcttagaccctgcaccttgctaactgatgctggggctgatggaagggaaatgccaggatggaaggagtcaaggctggggtcacagagctatgctgagggtgcagggccagagggtagtgcagggcttgggtccaggcctagggtgacagctgctactgtctcatctccaggcctgcacccccatgttccgggagtactccctgcaggttctgaagaatgctcgggccatggcagatgccctgctagagcgaggctactcactggtatcaggtaagccagcaggtgatgggtgagggcctctgtagcttcaggcagaggcccaggactcaccactccccatttcttacccaccttaggtggtactgacaaccacctggtgctggtggacctgcggcccaagggcctggatggagctcgggctgagcgggtgctagagcttgtatccatcactgccaacaagaacacctgtcctggagaccgaagtgccatcacaccgggcggcctgcggcttggtgagacctggggtttgaggagggaaggggctcccatgctggatgactgccaggtgaccttgggctatgctcatccctccccttgtgcctcgttccaggggccccagccttaacttctcgacagttccgtgaggatgacttccggagagttgtggactttatagatgaaggggtcaacattggcttagaggtgaagagcaagactggtgagtgagcaagaaggagccccgggccagccagttcccactcactgtctgctccctcccccagctgatctcactgccttccctagagctctgaccacttgtttcctcaccctctctctctagccaagctccaggatttcaaatccttcctgcttaaggactcagaaacaagtcagcgtctggccaacctcaggcaacgggtggagcagtttgccagggccttccccatgcctggttttgatgagcattgaaggcacctgggaaatgaggcccacagactcaaagttactctccttccccctacctgggccagtgaaatagaaagcctttctattttttggtgcgggagggaagacctctcacttagggcaagagccaggtatagtctcccttcccagaatttgtaactgagaagatcttttctttttcctttttttggtaacaagacttagaaggagggcccaggcactttctgtttgaacccctgtcatgatcacagtgtcagagacgcgtcctctttcttggggaagttgaggagtgcccttcagagccagtagcaggcaggggtgggtaggcaccctccttcctgtttttatctaataaaatgctaacctgccctgagtttccattactgtgggtggggttcccctgggccaaacagtgatttgtctccctcaatgtgtacaccgctccgctcccaccaccgctaccacaaggacccccggggctgcagcctcctctttctgtctctgatcagagccgacaccagacgtgattagcaggcgcagcaaattcaatttgttaaatgaaattgtattttgccca

SEQ ID NO: 415 - DNA, 5364 bp, Homo sapiens; identical to SEQ ID NO: 409

SEQ ID NO: 416 - DNA, 9656 bp, Homo sapiens
agcgccggctccgcgcctcgcgcccagtccgcgggccgcgccgccgctcccgccgctcccgccgctcccgccgctcccgcagccgccccgccgcccgcccggagccccgcgtccctaggcctggctcccgcctgcccgagacccgcccagcctgccccgctcagccgccagagaagatgcggctgctcccggaatggttcctcttgctctttggcccgtggctccttaggaaggtaagagtggcagggctggggcgctagcgcgggcgcggggttccgggacgcgaaggtcccagtgtgcgaggggctccgtgcgcccgccccgcccccagctccgagcgtcccaactttgcgcggcgcgggggaagcggacagacagactgcccgattcaggacgggcactctcctagcgcaagttggctgaggcttggagagggtgccgggcggaggtcccccttgcagccgacttcaggcgcggcgggggaggggacgaagcccgacccgcgagtgcgccagacagagcgggagtgcgagacagacagacaagccagcagggtgtcagccttgccgtctttccgcgccagtctcgctcgcctgcctcactgtctgtctgtccttccacccctccacccccgccttcccatttctcttctctgcacttgtcaccatgccaggtgggctctgtgtcgggagcatccatggcccgagcacacacgcacacacggactcaggcagacacggctgaacttggctacagccagcctcccatcacatttcccacggagacaccatctcccctgcacgacctcacagacacacccccctctcgtgccccactgaagggggaggctgtctggaaggggagtctctcctcccatgccctccctgcctccaaccccactccaaggcctctttccctgaggctctcgggcgaagagccagaggctaagggagctcagacttgatctgcctccttcctgacttggaggcttcaacctgcgaacatgctgtgctcatatgtgctgggtggagggcgtgggtcaccgtgtgcacctgtgtgcatgtgtccagggaagccaggcttggtccagtactggggccgagggtacatgtgtatactggtgtggtgtgtggtgttggctttgcatgagtgagtgtcagtgcctgcctcacagtgcagccatctgcctatgcccctggtgtgtgcccgcaatgggggcccaggccccagtcccccattttccttctaccagcctcccctgcctatggcttccctgttttctgacccccaactgtgacctacctagtttgggggcaggcaggtcattccccaaaccctcattctctgtaccctcagcccctgtagagtctagaaggggtgtatttcttcccccaacacttggacctctgcctgctcagccaaatcacatttggcaaaccccagcagggcaggggctgccccagtgaagctagcattagagctccctggccctcccagccccacctggtgaccttgaggggctgcacggtaggcagaggagcccctccatgaaaactgcttccactagcaggagcttcttagggacttgctgcccaactctgtccttagtgaactggaggagtggggggggtctgtgccctaccacccacccacccatgtgtgaaggcctggggtcaagaggtggtaggtatggcattctcttgcccctcctttccacttcctcccacctcatctccactctcccaggcaaataaactcccctgtggacagatctggtttaatttcctttgccccctgagggggaatgaaacatctggtggagacttgagtgagagtgagcgtgaggatatgagcaatgggatctatctgagtgtgtgtgtgtgagctgcagctgtggggcctccgtgttggagtcaacagggagagtggatctgctggttagcccagcttatgtgcatgtgagaatgtgtttacatgtgtacacactgcgggtgtgtgaatatgtataactgcacggggaggtgtgggtatatgagtgtttgtgtgtccaaatacctgtgtgtgcttctgtgcacttgtgagtgtggcgtatgcacatgtataccccggggtttctggtgcatctgtgtgctggggcccatgtgttgtctgtatgagtctctggggtttgtgagtgtgtttctgtgtgcttgtgattgtgagtgcatttgagtgtgctatgagattgtgagcctcaggatgtgtttatgtatctgagtgtggcttatgtgtgtgggtgctcaagggtgtcttggtgccagcactgggagtgggcaaaaggtgaggctgatcctgggtaagaggtggctaggggacagtttacagggcaactttttggcaaccctaaccatgaacggctgacacctctgcctctcccgtcctgcttgctcaccctcctccaggtttctctcccttcctcctcactccaggcttcccatttctcagagcctgggactcctggcttccactgcctctggggttctggcctctcagccagggattcttgaggatctttctcatacagtctctgactcctttccctctctctctgtctccccgaccccttgccaaagcagctgcctactgggagaagcagcaggcgatcaatagtcactaatcactaatcactaattactaattagctgggggagggcaggggcggggccctgtgggacctgccagctctatcccgcctcaggaaaggattaggtctgattctcttagagctggctggccgaagcccctcagccagctaccccctcctgcctccacaccctcctctagccccccagctaatctctgcctgggccacttaggcacgcacagcctgggctagggcccagagctgctgccggggatttgggggtaatcaggggccgcagctgggccagggggacaggggagggcctgctgtgacagctcccttgggccagagcctgcagtggaagcctcacattcctaataggaggggcatgcgtcagaaaggagaatttagagtgtcagggttgggatgggtagaggagctggagacccaggagcggggtgactggcgaagaggtgaggtaataaggacagaagcaaggcaaagaggggtcagggacgaggtaattggagagagacaacacaaacgtctaaagaaaacaggtaagtggggggacctcacaggggtcagagatggagtaattggcaaggagatggggaactttggacctagccctgcaactcaagatgtgtgggatccgtgagggacagggcaacagagagggggcagggtcataggagagggtcccagggctcaggcgcaggaggagtcgcagggcgtggggtgggaagcagctgcccagtggggatggggagcagggagcgctgccttgagcgctggaaattggcgcggctccccctctcccccgcctgcccctcctccacctccaccccgcccactccccctccggctccggcttcgggaaattacatccccgctccgcggctccccccaacccccaccgcgccccggagccggcgcctttataggcacatttattgcaataataaagtgaggcgcggggcggggggcgggggggcagtcgttcccgcggggaccgcgctggctccaggaagcagggaaataaaataaaataaaataaaataaaataaaaattcagataacggtgagccttgcgcggcaggccaagagaagtcaggcaggcaggggtagagggagggggcgtccagcccaagggcagagcctaccccaccccaccagcggtccccgccccctcatgcagtggtagggtctggaaagaggtgtcttcgcttcaacctgcctggccccctcccacagcctgatcctgcctggtctttgccttgccctctggctcctctcccatacctgtcctcagcccctgtctctgtccccgtctcctgtgtcttcccttgtcccccatttcccattccagtctccctttgagtcttccatccccatctcctgggtctctgcatccatcactgtttctgcccagtaaccatccccatcccccatctctgttttgccccaccctgaccccatccctgcctgtcccctgtgcttatccctcatccaccattcctgtccccatgctgcttcctggactgttctgtagcccatcttcatttctctggtccttaccccatccacatctctgtctctgccccacgcctggccaccatttctattctgcttctcatccctgtccccaggcctatcctcattgtatcctcatccctgtactctatatctgtgcctgccagtccccaatcccagtccccctccctctctgtctcagtcctcaccccaggctgtcctgtccaccccacctctctcctcacccacatctctatccctcgttcccagccagactccaccggcccctattgcagcacccctgcctctttctaggtgcaggggctcaggatgctcttttctccccttccccagcccaggcctggactgtcccttcctccggccagatcctgggagcaccctgcctgacccaggtggtaggggaaaagcaacgggccagcctggaggcccaggggaggtgcaccctgcaatgcggctggggggctgacagcctgatcctcccccaatcccagcagtgtcatccccaaagagccactccccgaagtggagtttgttgcccccagcagcaggaggccacctcaactccctgcaggtgcgtgggcccgctgcctcgggggtaaagccctcctggtgcagctctccccgctccccgaatgggcctgaaggagcctgctgaaccccccagctgccgcgcacctccgccccgcccccgcgccgacagcagcgctagcctctcccctccgcaaatgtcaccgcgcccaattagcttaattaagccagctctggagcaagggggacccctcctcggacaacatcctgctcccaccctcagccatggaggtgggcgacaagagctctgggcagaggagctccttaccacctgccttcccaactcccccacctccccccatgttgctggagacagacaacctgaaggacagcaggagagaaccacagacagagggagaaaatcagaatcatgggaggaggaaatttgagacagagacagtgagaaaagagactgagagacaaaagagactgagagaatggggagggagagatggaaaaacagcacaagagagggagagagagcacgagcaatcaagggagccagagggaggatcttattttattttattccatgttcccatttctcggctctcgtttcctcacagactctcacccctccctgtctgaactcccctacaaggtcgcttcagccgtgcccccccaactcttcctttttatcttggctgtctacagtagtgggtgggggcgggactgcccaaagccaggggattcgccaggatcagagaagcacagacggcactttgtctgagatcagagatgggggtgacaccctggaacctctccttaccctgctgaacctcctcccctccccctgccccttacttctaccccctgcccctgtctggtagaagtcactggcctgaatcaccccagccaggttctgactgggtacaagacataggggtgctctggtctgctgggaggagatggcttggaggcatttggggtcataacatctgatggcatggggataggggggacctggatgactgggcttctggaaagaacagcggttgggtgagattagggaccagagttcaaatggcccacccttcagctttcccaggaaacctaacctccctcccccaatgccctctctcagattcaggccctgccctctccaagcccacttctggggcctcttctccctcccactgtaccctgggacccctccctccaccctctctcaggcccaccctccaggtgttagctgctggcttaagcctgtctgtgggagtcaatcattcttgctgcccccgccccctcacctgggctgagaggagggatggatgggagggggaatgaggggggcgataaatatgtatgacgagcgggtggtggcagcattaataacccgggatcgcagcgtggcggggacggggaccaggcggtggagattctagcccagcagcttggctctgctgttcctgtccccagtgacactgtgtgtgtacacatgggtgtgggcaaacagaggggggcacccatgcttcctggcctccttacctacccacagcacagcctgtgggccagtgtaggacacctccccagagaccactcagatacaattgacatgcatgtatgtcacccccatcggaacacagcaagaccacacttgttctatgactacggatacaccccctttagaaagagcttgacacttgggcagaggatgacaggggctcacacaggaaaggtgacacctccagacaaccacatatagctaccctcagaccgctatacacagccatatagccaacccagacacgtaaccacaccagtcacacagacaccactccacaaattgacacacacacccagccaatccaggcacatacacacagtcaccgatttacacaacagacatgcagccacgacaagcagccacacacacacaggctcctcagactcataaccatgggcatccagatacacacccacacagccaccacagccacacacacatgtaccggccacacacacacaaccatttggggctaacagagacaccagaaccccaggctgacacacatggtactgcctccccccatgggacctgtgcacagtcagggccacagcacgcggcggtggtggctagctcaggctgactgacacactctgacatgcagctcctctcttgcctgctcccctcgctggagcggcatctccatatttcttcctcttgcttcctgtctccttcactcctggccacccccactcacccctaccccagataattgatggcccgggcctggcccggccgctcctgcctctcgatccatcttgtcctcgagcccatgctgtctccaagatcggtggccacctgagacacatagaacgggtgggagcaggagggggctccttagcccccttggagcccaggaaaagaacggccaggcggcctccaccagagtggagcactggcgactgggagggatacccaggctttcctcctctgctcaactggttcccagcactcactccttgcaggccagttggggctgaggcccaggtgggggctctggtctctgaggtcctggagcctctttctttttctttttcttttcctttccttttttcttttcttttcttttttttctgagagggagtctcgctctgtcgcccaggctggagtgcaatggtgcgatctaggcttactgcaacctccacctaccaggttcaagtgattcttccacctcagcctccccaatagctgggactacaggcgcaccccagaacgcccgcctaattttagtagagattaggtttctccatgttggccaggctggtctcgaactgaactcctgacctcaggcaatctgcccacctcagccccccaaagtgctgggattacaggcgtgagtcaccgcgtgtgccgggcgggagcctctttcttgatgctggatgttaatgtggtcacagcctccctggctcagtttgctcagagtccagtccctccctggctcattactggaaccaaccaggtgccgggccaggaaagatgagccaggatccagagctccactccctactcaccttcacactggctttgggtttttggccctcattggagctctgtgggccacatcaggattcttgacgtcatttcacagatgtacaaactgaggcccagatccatgaagtgactgggccaagactacatagcttgaaagggctgcagttctcctccaaggcacgctccctgcccgctgcgggactgcgtgattccatttggtctcctagcggctgtggaaagggactggcgtcgatagggctctggcaggatggcgggggacaaccccagcgtctctctctcctctttcttcgtgcacaggccgtcagtgcccagataccagagtccggaaggccgcagtacctggggctgcgccccgccgcggccggagcgggtgcccccggccagcagctcccagagccaaggtcttcggacggcctaggcgtgggccgcgcctggagctgggcctggccgaccaaccacacgggggcgctggcccgggcaggggcagccggggcgttgcccgcgcagcgcaccaagaggaagccgtccatcaaggcggcgcgcgccaaaaagatcttcggctggggggacttctactttcgggtgcataccctcaagttttcgctgctggtgaccggcaagatcgtggaccatgtgaacggtaccttcagtgtgtatttccgccacaactcgtccagcctgggcaacctcagtgtcagcatcgtgccgccctccaagcgtgtcgagttcggaggagtctggctgcccgggcctgtcccccaccctctgcagtctacgctcgccctggagggggtgcttcctgggctggggcccccgctggggatggcagcagcagcggcggggcccgggcttgggggctccctcgggggcgcactggcggggccgcttgggggcgcgttgggagtgcctggggccaaagagtcacgcgctttcaattgccacgtggagtatgagaagacaaaccgcgcgcgcaagcaccgaccgtgcctgtacgacccgtcgcaggtgtgcttcaccgagcacacgcagagccaggccgcctggctctgtgccaagcccttcaaagtcatctgtatcttcgtctctttcctcagctttgactacaaactggtgcagaaggtgtgcccagactataacttccagagtgagcacccctacttcggatagcgcccctccccagccagtcctgagcctcccgccaaatcccagcctcactaggtgggacccccttcccagtgttctgccgctcctgtggccatgtcgcccactccttccactctgggggcggaggggaatggcttctcgggaccctcagctagcgtgggtgcccttttccttatgcggagtgcccgcaaggctggggtagccccctccagtacaccccaaagtgaaagggataagagtgcagccccagaataggcggggcttggaggcggtcccaatgtcccctgggtccacagtgggtccccttttcacccttggcgctaggctgcgcactccctttccccgcagctttaataactcctggcctggcaccctcaccccaccctgactttcccatcccccagcgcttgtcctgcttcaccctaccccgcctaagactgtaaaggcctaaaaacctcggcctgtcctcccaccattctgcctgccatatgcctgtccccttttcctccaaaccctattagggtaccggaagcagaacccctgggctgaggccctggccctgcccccggcccctgcccctgcccgcccccctccagtccaggcagtcgagctccacctgccctctcctgctgcttcctctcggtgatattttttctacgccaaaacagacgggaaagggaacaaaataaagtgaaatccaataca

SEQ ID NO: 417 - DNA, 4609 bp, Homo sapiens; identical to SEQ ID NO: 412

SEQ ID NO: 418 - DNA, 5364 bp, Homo sapiens; identical to SEQ ID NO: 409

SEQ ID NO: 419 - DNA, 28430 bp, Homo sapiens
cggatccggattcggattagcagcccgggaagagtgccgtggcacaggcgccggagggagcgcgaccctcggaccccgcctggcccgcggggctgggacccggccccggcctgcccgatggggcgcgcggccccggagatgcgccctcgcccggccccgcgcccccggccccgcgcccccggcccgcccgccccggcccgcgcctccgcctgagtcccccgcgccttggcccgccaccccccgccccgcgcccccggcccgcctgcgccatggagcccggccgcggcggcacagagaccgtgggcaagttcgagttctcccgcaaggacctgatcggccacggcgccttcgcggtggtcttcaagggccgccaccgcgaggtgaggcccccgtccggcccgggatcccccgcccaggatcccctgcccctgcatccccgccccgagattccccgcctgtcccgggacccccccacgcctcccgagagccccactcgactttccaggccgacccccaccccaggatccccaccccgcgacccccagcccgactttccagttcagactcccgccccgagatccgctgccgggctttccagcccagatcctcactccgagacccccagcccgactttcctgtccaaaccctcaccccgggacaccccgcaacctggtcccacagccggctttcgaggctggatccctaccccaggacccccagcgcgatcctcaacctggctccccactcggccttccagtcccgggattcccaaccgggatcatctcagggccccacctgtgtggactggggtctgggggaggcctgcgaggggcagccctggccttgaaggtgcacgtttggctttcagaagcacgatttggaggtcgccgtcaagtgcattaacaagaagaacctcgccaagtctcagacgctgctggggaaggaaatcaaaatcctgaaggtgagccagtgctgggggagggggcgtgggcgtgggcgtgggcaagcccccctccccacactgataacaaacttgggtttctgtcctaggaactgaaacatgaaaacatcgtggccctgtacgacttccaggtaaggcctctgggctgcggtctgctggggaccgggctgggggactgtggccccaggtgctggatcccctggtgagcactggtgttgagcctgtccaggctggggtctactgggcccctggagactccaccctgggtccaggcctgggctggtgctggctcttgctgtgacttccccagctgtgagaccggggagggggtgtctgggccgcagggcgccccagggcagggctgagttctcctgaacaggcatcccctccccgccgggcgtcagtcctaggggccctgcctgagtccggcgtccccggctggccctggcagcactgccggcctggcccacctgtctaggccgtgtgtttgttgacattgctcctgcggccggcattggccggcctcgctctgcgtcagacggggcgggggaggggccgccggagactcctgctcgctggcagtcagggccgggccggggcacaggcggctgccgctggctggccaaggagatgacctcgggcccggctggccccaagaagcaagcggtgggaccagctggctttcgtgctgcctccgtgtcccggggcccagggcaggcagggctggggctgtgggagccagggtgccgtcctggggaccaggaacctgaggcgggagatccgccccgccaaagtgctgactaatggctctgtgacctgtttactgagcccagggcccagcccctggctgagggaagggctggcaggccgtgttttggtggcctcctccgtccgcctctcagagctttgctgtggccttggggaccgaggcttgtcacaaggtgccgggtggggggggcccaggtccagcgagtacctggaaacccaggcacactgtgtcctggagctgggccatccctcctgctgcttttcccgccctcttcccaccccttttctccctgctttcctccctcccttcctcctctttcctcatcctctccatgtttggaagcctcctgcctggaccacagcctgcacatgcgtcatggctctgggagccagcaaggagtggacagctgtccctggccaggcagcgactctgagggactccccctccaccctgggctacactgcctgctgctcccctccagggctccccaggtccagtcctgggcatctccaggccaggccctgtgactgtccgcacgacccccgcagacccgggaccagtatccccaggcccagctccatcccagtcagccacacacacctggttgtgggcatctgccacttcctccagtgttggcaactctgcggctttctctactcaggaagcacttggagccgccagctgcaggcgctcctgtctccgggcaccgggctctgctggagctgcagcttagcctgccctcgcccccacaggcgtggggattgttgccctgtgtcggtaaggcaatgtttgaggcaggcacccaaacccaggaaaaaataactgggttttaaaaatggacaatgaacgatttgggtgataaaagaaaatcctcaaacattacgggagggagtgcggtcgaggctagagtcctgcccccgatcgagtcccgctgccctccgttctcaggcccctgctttagttgtttccgggccaccggggacagccatccttacaaggcgatgtgttcaccggtgtccttccccgccacacccacctctctgcgccgtgaattttgtcacttaagagtatagtttgcactccatccagcctgggcgactgagcgaggccctgtctctaaaagagtagagcttggggaaggttctgtgctggctcaatccatatcagaaagtttacccctcggccaggcacagtggatcacacctgtgaccctagcactgtgggaggccaagacagaccagcctgggcaacatagcaagactcgctctctctaaaaaaaagaaaaaaaaagaaaaaaaattagccaggcatagtggcatgtctcagctactataaaggttgtaggaggattgattaaacccaggagtttaaggctgcagtgagccgtgatgttgccaccgcgttccagcctgggcagcagagtgtaaccctgtctcaaaaacacaaaacaaaaccctcaaaaagtttacccctctctgttagaggtcaccatctgtaagcacagtggtcgagagccaggctgacgctgatgaggggcccagtcctggctgccatatgtgcacacacagcttctttagtttgcggtcctatttcttcctctgtgaagcagaaagcacgggctgtgagggctgtgtgagggaggagggagtgctctcgggttggaggagccatcgtggaggtgctagctgctggcctgattgggtctgccgtggtgattttcagccatggcgtgcctgttgcccgagattccataactgatttcaccaaggccctgtaggtgggacatgaggttattttgggatgctggtacatcagggtggttgtgactggatccttagaagtagaatccttgggtaggagggatgctggtttttaatttgggtagctattgccaaatggacctccggagaggcaatgccactggtctctcagcctgtctccaagcatgtgtctccctaggtccttgccaggagggtggctctcagaggtttccatcgtggctcatgtgagaagtagaaaatgacatctcttatggttttgcttttcttttttttttgagactgagttttgctcttgtcgcccaggctggagtgcagtgacacaatctcccctcactgcaacctccgcctcctgggtccaagcgatcctcctgcctcagcctcccgagtagctgggattacaggcgcctgccaccacgctaggctaatttttgtatttgcagtagagacacggtttcaccatgttggccagcctggtctcgaactgacctcatgatccacccacctcggcctcccaaagtggtgggattgcaggagtgaaccaccatgcctgggcggttttcttttacattggtgatgaatgagcttccctatccgagcatgggaatgttagaaataccacctgtcctttgtatagtgtatttctttttttttttgagatggagcttctctttgtcacccaggctggagtgcagtggcgcgatcttggctcactgcaacctccacctccctggttcaagcgattctcctgcctcagcctcccgagtagctgggattacaggcacctgccaccacgcccggctaatttttgtattaaaaaatttatacaattttcgccacattggccaggctgatcttgaacgccggacctcaccttcgacctcccaaagtgctgggattacaggcatgagccaccatgcccagcctgcctgatatatttctatattttatatatacgtttttctgagatgtagtttcactcttgttgcccaggctggagtgcagtggcaccatctcgactcactgcaatctccgcctcccgggttcaagcgattctcctgcctcagcctcccgggtagctgggattacagacatgcgccaccacgcctggctaattttgtacttttagtagagacaaggtttctctgtgttggtcaggatggtctagaactcccgacctcaggtgatccgcccacatcggcctccgaaagtgctaggattacaggcatgagccaccgcttctggcctattttaatatattttttaaagagactgggtctcactctcttgcccaggctggagtgcagtggcataatcatggctcactgcagcctcgaacacctgagctcaagagatcctcccacttcagcctcctgagtagctgggactacagatacgcaccaccatacttggttaggcacatatttctggcaagctcttggtcccttttgtgccaaggctggaagggtaccatgcttaacaccatggcccctgagccattctgccatttgctggatcctagctccaacatttacctgtgtgacattgggcaggtagcctcctggcacctccgttttcttaccttttaaaaactgttggctgggtgcagtggctcacgcctgtaatcccagcactttgggaggctgaggcgggtggatcatgaggtcaggagatcgagactatcctggccaacatggtgaaacctcgcctctattaaaatacaaaaattagctgggcgtggtggcccgtgcctgtagtcccagctactcatgaggctgaggcaggagaatcgcttgaacccaggaagtggaggctgcagtgagctgagattgcgccgctgcactccagcctgggcgacagagtgaaactctctcaaaaaaaaaaaaaaaaaaaaaaaactgttgtggttgtgatggcatcttgagtatgttaagtctttagaactgtgcctgccactttgtaagtgctctgtcaatgttcttgaaaggtaggtgtcctttatatatgaagcaaagtagcttctttgtgataggttacaggtattccccgccatgttgtttgttgactgttgaggttgttatttttgttcttattgtgttgggttttgtgtattgggtttcttttttagccatacaaaattgtgaaaatgtgagtgcctgggaagtgtgtgccttgggtcacgctctttgagtccaccacagccgctgggaggcggctggagcacctggggagcacctggcctccttactgagcatgtggtgtccctgtctggacttgcctggccccaggagtgcggccaccacagaaatcagggtatagggctgtggagccaggctgggatcctgcccagcatgccctgggaggagggctgatggctactggccttgctgatggtggcccccctggccagcacgccatctgacaggttccttgcagctaaaggtcttgctgggccacccaggtgtgactcactcaggccctgcagacagagccgctgcctgtgagttacttgcagtggagacctgagtcaagaggtgtccagccctgcttggggtcctgggagaccatgggtccaggcagtccagcccagcatgagactgtaactccccatcccagagtgaggagggggctgccaggcctggcctggtctggccggggggctgtctgcagtgtgagttggggcaggatgcaggccgagtagaaacccgtggggtgggtacccagctcctgggcaggggcctgtgaaggggctcccagggcccaggcagttctggaattacctccgaagttgtgtatatctttttttttttttttaactttgaaaacaatgggatgagactgggcacagtggctcacgcctgtaatcccagcactttgggaggccgaggtgggcagatcacctgaggtcaggagttcgagaccagcctggccaacatggcaaaaccccatctctactaaaagtacaaaaattagctgggcgtggtggtgggcgcctgtagtcccagctacttgtgaggctgaggcaggagaatcgcttgaacctgggaggtggaggttgcagtgagctgagtttgtgccactgcactccagcctgggtgacagcgagactcgtctcaaaaaaaaaaaaaagaaaaaaatcatgggataaaaatactggaaagtgcaaaacagatgagaagatataccacaacaggccctgtgtggcgtagcaagcgccagcccaaagccatgcccgcgtcccgggccgctctcctccctcctatcgagggcacgtccgtcctcctgtgtgcccccctccccctctgctttctcattcttcacgtgagccagctcctggttcccacacgctccctttgccacatgctgactttaagcctggaggtgggatgtcagccgtaggttgaggggtgctgtgtctccgtgggtgacaggagttggtttttgtttgtgcgcagcaccccgtggtgggactgtcacctggtatcagtatctgtccgcgatggctgggggtcaggtctcagccacctgaaggacagagctgctgggaacagtttttactggggtgtgcgccaactaggatggccgggtctcggggggaatgtgaggagttggcgtcttcctgagggtctctgcagcttacaccccctgcaccccccaactcgcactggggttgtttcctgctttttccaagcaaggtcgtgccctcagaagggttgggccacccacccctgcctcactgcatctagggacctgcctcaaccccctgcggctggctcccggattgtccagacccccaggcccagcaggcgggaggctgcagaggtcagccttgggctgcagccccaggaggcccatacacaatgggcggctgcaggtggttccccagggccagagggtggcccttccttcttagggtggagccggcatcccttcccttttgggagctgtccaggagccccgcctgggggtgcagagtggttctgtccagccacagctgtggcttttgccactttccggagccagctctggaggtgtgaactaggtcagtgcctgctcaccaggcccagcccaggatcaccagacaagagtagggctggcagagggtgggagcctggatcctattaagtaaagcaccttagcaccccaggggtggggcagcctcctacgtgcccagacacccgtgccaggctgcctgggacacctggctctggccggccgtgggtgcgtgtgtgcagggtgtgggggccggcctgcctggggagtgctgtcccaggtccctcaggcatgctgcctggagacagtggggtgttgatattgctgtctttttgaagtgttctgagcctcagatgcatgtgttgggacttttcagggacagccctgtggaatggtcagcagccgttccctgtttcctccctttaaataggcggcaagttgggacccacctcccggggtgggggtgatggtgcagggagcctggtgtgtttgattagggcatgggcggtgtggccacaactgtgtgtgtcaccacgggacggacccccggaccctgtcttgggaggcgagctgctctgcctggggtggccggtttcctcccctggagcccagggaggcagttgtggccctttctggtgtcttaactgggtgacttgattctgggagcttgcccggtccccactgcccagggtagcttgtgaaaaccaaatgtagctgcgaggcagacgtggagcccgatgccctgtgtgggttctgcaaggcagagctggagcccgatgccctgtgtgggttctgggtgggcccaggggaggtcagctgtggccggtgaggctgtgctctcacctgacccccctcaagagccctagagagagtcgctgcctgtgggaagggtggacaggcccagctgggggcccccgtcggggggtgttgtggcgcagggcctgggcctgcagctgccctggaggagctcccccagccctggcagaggtggtcctgggcttgtttgtcctcacttctcatccctgactctgccagggttggagacagcaaggctaggtccttccggggacacagagggtgactggcttggcattggcactgggcagagtgaggacaggactccagcccacctgcttgggctgtgctgccatttcccagcctgggcacgcctcccaacctctggggcctcagtgtgctcgtatgggaagtgggctggttatggcctgctgcctgggctcctgcagggctggtgtagttcaacttcacaggaggctctcggaggcacgggaaaggccctggtgtgccccgatgcccagctcagggagttggatgcccacagccctgagggcctgtctgaagctgtcatctgtcccaggggagttgggaagacccgaatgcctgtggtgaggtggatgcccccaccctaccctgcagccccacccccagtggccttgagtcacctgctggagaggaccttttaggagagaggctgagcatgggccaggccttggtttctgcaagggaccatttgaagtgcagggaagaggctggaggtgcttcggtcccacagccccctgcccactccctcctgggagctggtgccccctgaggttttggggacagaggagggctgccagcacagtggggagggcagaggggtctctaggaaggtgacctagggggtgacatctgtgactctggggcaaggccaggggtctagacgtgtcagtagcgaggtgggttccagcacccatgaggccagtgtggctggagggatggcagggccaggtgccctgggtaggggtgttggggaccctggctagagtgtgggcagcagatggggtgggggaagagcctccttgccagggtcctgtgggccagtcactggtgccacaggggtctccctggtgggcctctgcctttcttctttttgagacaggtgtcattccgtcacccatcctggagtgcagtggcacgatctcccggctcactgtagctgtggcctcctgggcctaagccaccctcccacctcagtcctgagtagctgggactacaggcgtgcactgtcacacctggataatttttgtatttttttgtagagatggggttttgccatgttgcccaggctggtctcaaactcctgggctcaggcgatcctcttggcttggcctcccaacatgctgggatgacgggcatgagccaccgtacccggccaggcctttgcctttctaggggtgagaggtggctgccttagtgtttgggggtgggaggaggctacagggcttcagttagcaccccctgcccagagggagctcctgtcccacacagcccggtcctgggtgagtggctgggggatggggtgctgggctcctgctctgcacacatgggtgttcccccaggatacctctgactttgacacatccctgcttgtcctggctttgctggtgggtttggagctctgatgagcaggtcaggtcttagggaacccctggctctgggatccagggcaggtggcccccagagaggagaggagaaatgtgggcacctatgggcactcactggaggggctgtggggagggtaatggtgggcccaggtcagggagtgggcatggccgtcctgaagttatttctgagtctagcttcatctccccctccttcctgggttctgcccggagctgtccctgcagtcccccttgccccatcctgtgctctgtggattgtttctccccacagctgctgggagccctgggctccccacgtgctcttcctgggcaggcaggtgaggccaggcggggcttggggtgcacaggctgtgggtggggtgggctgaggcctgcctcatggataggtcccaccttctctaggctgtgcctgggtttctgggtctccctctgggccggccctgcagtgtctgtggatcctggggttgctgcctgagcaccatcggccttagcctccctaaaggcaccctctcctgagcctgtccccactcagcatcctcgtccagcccatagctcctctgcgggggcagctctgggacacgggcttctcacgtttatgaagcaggcatcacccagtggctttgcggctgtcccccccaccaggggtgccttctgattggttggggcctcctgggactgggggctgagcaggggtcctgtgtgggacgcggctcctgaggcgctgaggggtgttcctcctgcagaccccctccagacacggctcccctttgctttgagagagcctgggctcgctcaggggtagaagtgggatggccctacaacaggtgtggactcgcttccctgtaagcacctagagcatgtggatgtgtacagggcagagggagggggctttgtgtggaaagggcttcctcctcctgttctgaggcctagagtcaggtgtgtggggcccttgctcctccagcccagcctgcctggtttgatgtggcttcctgggcctcactctccttgtctgtgaaacgggggtgatgaggactcgtccctgtggctgcggggagtgagtggtgggctacagggaggctcccagtcccaggtgagggtgtacgcatgctggccgttggggtgtgtgctgtgtctgcaccggtggcttactctgagtttcatgggggcaggaaagggcggggtactggtggcacccccggtcaggtctgtgtctgagctgagggctgagcagctgctggtcaggtcttgttggcccagcagcggagggggtggctgagacgcctctgaccgaaggcattggggcgagggatggcagcctgagctgcagccaggttgggtagggcagctggaggccgcaggcctctgcgtcaacctggcagcgccaacctgcaatctgttggcgtcttctttttttttgagatggagtctcactctctcgcccaggctggagtgcagtggcacagtctcggctcactgcagccttctcctcccgggttcaagtgattttcctgccttagcctcctaagtagctgggattacaggcacgcaccaccacgcctggctaattttagtattttaatagagacggtttcaccatgttggtcaggctggtctcgaactgctgacctcatgatccacccgccttggcctcccaaagtgttgggattacaggtgtgagccactgcacctgtttaagttttgtatttttagtagagacggggtttcaccatgttggccaggcaggtctcaaactgctgaccttgtgatccacccaccttggcctcccacagtgctgggattacaggtgtgagccactgcgaccagccctgttggcgtctttgatcctgggctgaggagctgagaagcttctatggcctgagggtcacacacacctgcccacacacctggccttcacccttcctgctagggggtatgtcctctgccaggagctgttgctcttatggggggaccaggggcctttgccttgatcagatggagacctggctggccacaaaacagaacacacccacctacaaagcacgtggcccagagatgtcctcgtctcccggccgctggctgaccagctaagtcctggcactgcagggcctgcccaggccgaattggggctgagccagactccctgcagtggggcccggtggcactgggacctctcacagcctcttttctgtcttgcaggaaatggctaattctgtctacctggttatggaggtgagtgccttgtggtgccaggacaagtgcaggctgatggccatggccctgggagccccacagggagggacatggctggggggagggtgatgagcaccttttctttttttttgagatggagtctcactgtcgcccaggctggagtgcagtgctgcgatctcagcttactgcaacctccacctccgggttcaagcaatcctcctgcctcagcctcccgagtagctgggagtaattacaggtgtgtgccaccacgcccggctaatttttatacttttagtagagatggggtttcgccacgttggccaggctggtcttgaacctcctgacttcaagcgatctgcccaccttggcctcccaaagtgctcggattacaggcgtgagctgccacgcctgctgagtatcactattgatgtcttccagcagggactgtggggacacctgccctgggctgggcaggtgcctgcgggctcagggagtagtgtccaagtgtgaggggtggggaggctgggcagggctgggaggtgggccctgggccctgctgcagcctgatgcgtgtctggtctcttgcagtactgcaacggtggggacctggccgactacctgcacggtgagtgcacagctgcgccacctgggctgccagccggtcccacagggcccgcacccagggccacactggcccagtctgggaggcagcctggctcgagtgggtccttggctcattgtgagattggctctttcttgtccccctgggcctcttgaggggatgcagggagctgagctgctcccggctgttaaggatgcagtccctccgctggcctcccccttgcttgaggagacagctgtgaccagaatagcccgaggggagccgcacaaaccaggggtgggggctgttgtcttcatagtgtggctggaaggcggctcttggcccacccaaagttgagccctgtggcggatgggaggggatgtgctgcacggggcggggcggggcagagggaaggacagcaggggggcggccgcgcccgtctgttcccaggctctctgggtgggggtccgggccacagtgccggcgggcgcgggggtgggtggggcgccggcggcctcttgggggtgtcctgagggtctggaggtggctctgggacagttccggggacttgggcctgagcacccgggagccggcaggactgctcaaacgccggctcagacccgcgtcgccctcatagcgctggggcgggagtgcggggctggtagatggacaggacccgctggccccctcgcctcgccccacgcgaggaggaccccacggaccaagcctgggagacagacgctgaggccgcgcgtagctgagactggggctgcgggtcgggtcgggctgtgcgcggctggcacctgtctggatgccgggaagaggggcaggagcgggacccgggcggaaccgcggtggcactgaggctgggcttcggcggcctcccgtctctggagcagctgcagcccggggctgagtggtggggccggcgcgccgggctctgcgcaggagcttcaggtgcgccctggtctcggcggcccgtggtggcttgtgcccctcctgacccggggtttcctcccggcctgcggccctgcctggcgctctccatccgtgtggcgggaccggcctggctgcgcgggactcacccctgggggaggaaacacggcccccaggccctgagccgcctctccccgcagccatgcgcacgctgagcgaggacaccatcaggctcttcctgcagcagatcgcgggcgccatgcggcttctgcacagcaaaggcatcatccaccgcgacctgaaaccgcagaacatcctgctgtccaaccccgccggccgccgcgccaaccccaacagcatccgcgtcaagatcggtcagcccgcgggcaggcaggcgggcccggcggggaggggctccggggccggcgccggtcctgacgcttctctcccgcagctgacttcggcttcgcgcggtacctccagagcaacatgatggcggccacactctgcggctcccccatgtacatggtgtgtttaccttggccgggctgtgccgggtgggcgcctctctgggcttgctggttggttggctggcgtgtggtgcgctctgctctggttggctgtggcctggcgggcaccttctgtggttggcgtgcgggggcctcacactgacccgacttctggtcccgcaggcccccgaggtcatcatgtcccagcactacgacgggaaggcggacctgtggagcatcggcaccatcgtctaccagtgcctgacggggaaggcgcccttccaggtaactgggcttggccctgctccccacgccgcaccgtcagtgcaagtgtccgccagctgcggtcagacgccccctgcgagccctgcccgcgccccacgagctcccctcgggtcctggctggcggggcgggcgtccaggggtccagtggggaaggggcctcggtgtcccccagggagggcggcgccgccggcggtgactgggagctgcccccggcaaggcctccctcgcctgtctggtcgcctgtctagtcgcctgtctggtcgcctgcctggtcagaggtgagggcagcgccggggccgagtgggtgagggctgggaggccgcgttctggggggtggacaccccgagagaccgtcggcgccccctccccgcccccatgctcatacctccagcagcaaacagccgcgctagcacccggtttcccccgggcttcgcagcgtctggggcaggggccgactggggacgaacgcaccgagaccccgtgggctggtcccgctcggccgcagccctggcagtcaggctgtccccgtccccgcaggccagcagcccccaggacctgcgcctgttctacgagaagaacaagacgttggtccccacgtaagcaccctcccgccttcccttcccttcccccgcgggctccggccccgcaggccctgctcacaccagcctcctcttgccccagcatcccccgggagacctcggccccgctgcggcagctgctcctggccctactgcaacgcaaccacaaggaccgcatggacttcggtgagcacccaccaggggcgcagctggagtcccccaccctccttccttgcatttgctgatgtgagcagggcccaccggcttcacacccagccccatgtgcacactgccctttccacaagccaagcgcaggcaggggctccacctccgcccgggcaggtgcccaacgcggctggagctcaggccgtggggaggcaggggcctggggtcagagctggggtcctcctgaggcctcactcctccttcctcctgcagatgagttttttcatcaccctttcctcgatgccagcccctcggtcaggaaatgtgagtttctgtgggtcctggggctccgcatgggccctgcatgcaccccttcctccccgggtttggttagggcactgagtgtggggcagagggagcaggtcttgagctgcggccagctcccagggagggcaggacacccggctccttgctctgctgcagcggggaccccaaggccaggggttcgcatggtgcagcaggcttgggatggggatggggtgttggaggggctggtgctgccctgtgacagtcatagggtggcccaggagggagcctccctccttcctgctggtcggggtgtagccggaagtggaggggatatggttgagcttgtccagtctgtgggttggctcgagggtgaggaggagacaggaggatggcccagactgacctatgcatgtttatctcagccccacccgtgcctgtgccctcgtacccaagctcggggtccggcagcagctccagcagcagctccacctcccacctggcctccccgccggtgagttgccgccccaggggcttggcagcttctccctccactcagcagtcaggggctccagccctgggcccccgcggggacgtgctgtgacttctgttgtctgtgtgagtcacgaaagacatggatgagttcattctgtcagatgttgaagccccacaaacgggtgacagcccctcccaacacccacagccctcaggtcccagaggccgatagggcggctgtttggtctggtcctgtctttggttttgtgctgacgtggacagaagcagcgtgtggccttggcccactgacacctgcacccctggcctccctcgtgtcttccattggactcaaagcatgagtagggttgcagggtgatggccccacatgatgatggcactccttgtgtgacatgggaggggtctgcagagcacctgagtcggccatgaacccccgtccctctgtccatctgactgggagcctggctctcaggcatggtgttgtggctggtggtgatgagttcatgtctgggctctcctggcctggccccctgctctgtgaccagggaccggtcctctgaccttggttgtctgcctgtatcatggccgaaagctcagatgtggcgaggggagcgtggcagcgccctgctgtagggagctgtggcatccgcagacctgccctggggcacttggggctttagccaccaccgcacggatggtgtgccctgggccttagcatggtgctggcctcagagcagggcccaccggggtggcagcctctccactggacacgccttccatggtacctcgttctcttggctatgccgatggaaaagtgaggtgcagagggcaggtggtgaacaactccccaaaacagggcctcccagagcttctgggagctgagggcttcaacccacccaggctgcatggtgagagtggctcgtcggggggcctgtccctgcgaggtcaaagctggcctttgagtggagtgctctggaagtacagagaagagcggagcacaggaagaaagacgtgcccagcccttctcagccccagcgccccgatctttactggggctctgggccatcccaggagggggaatttgctcccctgagtgtgtaggtccctgagacctgctcaccagcccctccgttgactctcagtccctgggcgagatgcagcagctgcagaagaccctggcctccccggctgacaccgctggcttcctgcacagctcccgggactctggtggcagcaaggactcttcctgtgacacagacgacttcgtcatggtccccgcgcagtttccaggtcagggggcacgctgggcttggaggtgacgcctcaggtgcggcggggacagtgcattgcatgtgttggatgcacagtgtgtaacacatttccacttatgggcagttaggatgggcccctgggagccaccggcatcggcccagcttggttggggaggccgtgtctgttaaaaccactcctggaatcaaagccgggtcctcctagtggtcagtaggaggtcggaggccataggcctggtctccttagacagtgctgctcttcggatgggtgggggccgctcacctcatgcccctcccccgccatgtacccctaccttgtttctcagcaactcttgttgcctctacaccctgcaggtgggtttattccttggcttttggggaaccccccgctccataatggccaggggctgcccacgtgtttgttgaatgaaggtgcctaaacttttggagcaggcctggggtctgtggctcctctgaaggccctgcactctgtccctggctgtcccaaagctcctggaggtctgggttggcactggtccccgtgtctgccagggacacaatgactcatgccgagccctccgcctctcccatcagcatggcttctgcgggggtggtgaggcccgagccaagccccagacagacccggggagggccttggtcctttgccagctgtcagggcaacaggaagacggacaccaggggtagggcagagcctccttgggggtgggaacctgggtattcctggagggggttgggcccagacttagggctgtagatgcctgacctcccccgcccatcctggagttagctaaaggctggggggcagggccccaggggtctctggggctgaggagacaggaggcgcagagtccaagtggggataagcgggggcaggtagcgctctggtctcccggagctggcctggggctggcagggaggatgcagcctggactgtaccacccaggctctgccccccgcaaggccgctgtacgagctgaggcccctgcaaggtggagtgtgcgtggggatccagcagagagcctcggtggggtggggtggccctgggcaggcggcaaggactccaggcccagccttgtctccccctgcaggtgacctggtggctgaggcgcccagtgccaaacccccgccagacagcctgatgtgcagtgggtgagcccccatcccttacctctgtattttaggggagagaaactgtggccttggaagtggcccgtgttatttacaatgagccgagatcgcgccactgcactccagcctgggtgacagagcgagactctgtctcaaaaaaaaaaaaagtaaatgccgttggcccgtggtggctcacgcctgtaatcccagcactttgggaggccgaggcggatggatcacaaggtcaggagattgagaccatcctggccaacatggtgaaaccccgtctctactgacaaaaaaaagaaatgcaaaaaattagccaggcgtggtggcacatgcctgtaatcccagctactcgggaggctgaggcaggagaatcgcttgaacccaggaagcagaggttgcagtgagccgagattgcgccactgcactccagcctgggtgacagagtgagactgccccaaaaaaaacaaaaaaatgcccttggcctcccttctgccccacaggagctcactggtggcctctgcgggcttggagagccacggccggaccccatctccatccccaccctgcagcagctcccccagtccctcagggtaagcagggccccaggctgggtggatggggctgtgaacagtcccccggctggaggttgggcttcctgtgtgtcgcagccagcccaggcctgctgtgtccagaggcccctgccttcttctcccaggcctcgcaggatggggtctgctgggtcgtcctgcagaagggactatagtgggaggagcattgacaggagtaggtgaatgaggaaaccaaccagggacgccagggccagcacagtcgagcctgtagggccaggaatggccagggccccggccagggtggccccccactggctgggtgcagactgggagtccaggtggggtgcaggtgccacatttctggtgtgtgtagaggcatggaagccggctcttttcagacctggcatgggtctcagggtggcctctgccctaactaggaagtctgggcctaggctttcttctggtgccccagctccatgacctcagcctcttgtgaccccagtgtctgtcatgatcctgacctctctccaccacagccgggctggcccgttctccagcagcaggtgcggcgcctctgtccccatcccagtccccacgcaggtgcagaactaccagcgcattgagcgaaacctgcagtcacccacccagttccaaacacctcggtgagtgtggagcccccaggtagccaggcgtggctggggccttgtgtggcaggagcccttccacggctcccatagagggacagggtcgtcatccatgtgcagttgtgcaggctgcgcactgcgtaactcagcaccaccatttactttgttgatgtcttgggtttctagagttattttgacagttttctgatcagtaaaatctctctagtttataaaatcaatattgactttggccagttttaacagacagaagtaaatggtgggaggaaagggtacctttcttttaactcacagaaggctgtgtgggccagtgggtgtctggcaggggatggagactttagggtgagggtgccttgggttggcaccccgggcaggaaagctaaggggccaactcctcccacacacccactgtgtggccggttacctggacagagtgcattagaggatgagccatctgtcagcactgtagccacttggcgtggcatggggtcctgggctgctggggcctcccctcctaatacctgccttgtccccaggtcctctgccgtccacaggtcaggcagggctgctgaggcctcccctcctaatatctgccttgtcttcaggtcctctgccatccgcaggtcaggcagcaccagccccctgggctttgcaagggccagcccctcgccccctgcccacgctgagcatggaggcgtcctggccaggaagatgtctctgggtggaggccggccctacacgccatctcctcaaggtgcgcctgcaggctggggcctgggaaggggcgtctgtaggcagtgggtgaggaggctgtctctgtcccagctggaccctgacagatctctcttttccccaagttggaaccatccctgagcggccaggctggagcgggacgccctccccacagggagctgagatgcggggtggcaggtcccctcgtccaggtgggtgcagtccggaggggggagggggtgctaggctgacctccctcgctcacgttgtcatcctggtctaaagcccttgctctttccaagtgaaaaggagtgggaaggaagctggtggaacagaagccaactgcctctccacctcctggctgtgtgggctggggcaagtttcttatcccctctgtgccagtcttctgtgctggctgagggtcaggtttaagagtggcgcctcagctactcgggaggctgaggcaggagaaccgcttgaacctgggaggcagaggttgcagtgagccgagatcataccaccgcactccagcctgaatgacagggcgagaccccgtctcaacaaaagaaaaagagtggggccttggagtgcgtctaccccaaggggctccgtgtggtagcagtggggcctagggctgggccgccggaccggaaggtcgtgacgaggcgtgtctctctctaggctcctctgcacccgagcactctccccgcacttccgggctgggctgccgcctgcacagcgcccccaacctgtctgacttgcacgtcgtccgccccaagctgcccaaaccccccacggaccccctgggagctgtgttcagcccaccacaggccagccctccccagccgtcccacggcctgcagtcctgccggaacctgcggggctcacccaagctgcccgacttcctgcagcgaaaccccctgccccccatcctgggctcccccaccaaggtaatgggcactgccatgtgtgcaggggcacagagccctggggaagatgtgtgggaatggccagtcctgaacaaagaccgaggaaggcagctctgtaccttttgacccccgcctgggctcatgctcaggctgctcccacatgcctgccagttcctgcggactcggccccttccccaggcaccgggccccagggctgcagacctgcggggcagtcttcaccccatctctgtcctcctaggctgtgccctcctttgacttcccgaagacccccagctcccagaacctgctggccctcctagcccggcagggcgtggtgatgacgccccctcgaaaccggacgctgcccgacctctcggaggtgggacccttccatggtcagccgttgggccctggcctgcggccaggcgaggaccccaagggcccctttggccggtgagttgaggggacaggccttggacgggcttctgaggggcagcctctttcccctgcattgttctgctgggtacttctggggggtagaacaggaaaagcccagccttgcccttctgtgggtgcccagtgtggctgggtgccagagagcctggcccacctgtggctggccctagacccacagcaggtccccgtcctgagcctcgccatgcccgcctgtaagctggggtgacaggagcgcctgcctctcgaggtgggccaggagaccgtgcatcatgtgtgtctggcctgcagagggacctctcgaggtccagttagggtggggtgggccgggcacccagcacagccctgcacactcccacaggtctttcagcaccagccgcctcactgacctgctccttaaggcggcgtttgggacacaagccccggacccgggcagcacggagagcctgcaggagaagcccatggagatcggtgtgtgggtgggtggggctcggaggctgtgggatgggggtcggaggctgtgggatgggggtcggaggctgtgggatgggggtcggaggctgtgggatggggctcgaggctgtgggatgggggtcgggtggggcttggaggctgtgggatggggctcgaggctgtgggacgggggtcgggttcggctcggaggctgtgggacgggggtcgggttcggctcggaggctgtgggacgggggttggggggagctcggaggccgtgggatgggggtcgggttcggctcggaggctgtgggatgggggtcggcgggagtcaggatgctcctgagcccttccttgctctcccagcaccctcagctggctttggagggagcctgcacccaggagcccgtgctgggggcaccagcagcccttccccggtggtcttcaccgtgggctctcccccgagcgggagcacgcccccccagggcccccgcaccaggatgttctcaggtgagggctggctaggctgaagccctgtcccttttggggtggtggcagcgccctagcggacgggggcatcctttaactcgggtcactggactacagccccccagagcccaggggtgcctgaggaagcagctcaggcccctgagaaacccctgctctgtctccccgtctgcgaaatggacgtggttctggtatccacccctcagaccacccctgccactcaacctgtgagcggtaggcgctcgttcccatttatccccaaaacatgaggtgagcagggacggtgtctggatcatggcctccttgcccagctgccgtgggctgtgctgtgttggtcaggagttgccctgatgagcacaggccgtgcagacaggcgtgcccctcggttccccagccagtggtgtgtggggatgctctgggcctggggcctggctgggtccccactgcgggttctgcctggggaggggtgggcttgtgggcgtctggtcctggccaggggctgccatcgctggggtcacctgccagccccatagcgaggatgggggactgccttgccctttgaggtccttttgggccttgggcccagctgtggggcacagtagcacaccaagccacgcacctaccccattccagacagtggcagctgccctcctcccaggcagatctgggctgggggtcgggatacccagagggtcccttggtgggcaccgcagcccttggcctgaggtggggagctggggacttgggggttgtggtgagtggcaagaggttgaggagtggctctaggggcctgctgtgcttctcctgttggagcattgggatataacaggtgtaaaccgaggcagaggcacattgggccctggaggtgtgggagtctgtgggggatggatgggggccacggtgtctgctggtcctggtgtgcccctcatcgccctctccctgcagcgggccccactggctctgccagctcttctgcccgccacctggtgcctgggccctgcagcgaggccccagcccctgagctccctgctccaggacacggctgcagctttgccgaccccattactgcgaacctggagggggctgtgaccttcgaggcccccgacctccctgaggagaccctcatggaggtgagggctggagtgagcaaaggttcccattctggctggagggtgtgtggggtgtgtggggtgtcgggtgtgtggggtatagggtgtgtggggtgtcgggtgtggggtgtcgggggtgtggggtgtagtgtgtggggtgtagagtgtgtggggtgtggggtgtcgggtgtgtggggtgtcgggtgtgtggggtgtcgggtgtgtggggtgtagggtgtggggtgtagggtgtgtggggtgcagggtgtgtggggtgcagggtgtgtggggtgcagggtgtggggtgcagggtgtgtggggtgtcgggtgtgtggggtgcagggtgtgtggggtgtcggctgtgtggggtgtacggtgtgtggggtgcagggtgtgtggggtgtcgggcgtggcacatcccagctgcccgggctgcagcaggggagggtaccctgccctgcctccccaaggcgtcatcggtgagtctgaagggagacaagccccttccaagcccgggcagcacttgccgccctgacggccgcttcctgcagcaagagcacacggagatcctgcgtggcctgcgcttcacgctgctgttcgtgcagcacgtcctggagatcgcagccctgaagggcagcgccagtgaggcggcggggggccctgagtaccagctgcaggagagtgtggtggccgaccagatcagcctgctgagccgagaatgggggtgggtgccgccagggctggggtggggcgggtggtggcctgggggccaggaccaaccggcctcctctgatctgcctgccgcccccagcttcgcggaacagctggtgctgtacctgaaggtggccgagctactgtcctccggcctgcaaagtgccatcgaccagatccgggccggcaagctctgcctgtcgtccactgtgaagcagggtgagggctgcgaccgctcagcccacatgccgggttggggaggaagcccaccttgcaactgcctgggtgacagggtaacagggaggctgcttgagtaggcccctgtgcagaggtgcagaggccccggggcctggcccagtgtgcagagcacagaggccattgggtcggacagcaccctggagcccagtatgcagagcacagaggccgtggggtcggatggcacccgggacaaggtgcggagcctggccacaccctcaaggccacggggagccagggctgtggcagggagggagggacgtgctcgctcagtgcaccgggcagatcatggccactccagccctgccccgtgtctgctgcaccctgagctgaccaccctcgtcctttgcagtggtgcgcaggctgaatgagctgtacaaggccagcgtggtgtcctgccagggcctgagcctgcggctgcagcgcttcttcctggacaagcagcggctcctggaccgcattcacagcatcactgccgagaggctcatcttcagccacgctgtgcagatggtacgggacagacagacaccagtggggcaggggccaggaacttccaggcccgccgtctccactgggacgggaccttgatgcccacagcgtggtgagactttggggggtgtcacttctggaggtcttgaaatgacagcattatgcacccccagcctcctgcaggcgctcgcagctcggctgggtgcatccttgattgtacgggtgccgtggcccatgtgcatcctgcctcgccccgactcagtttccccaattgtaaaatgagagacttggtcttcaggcctcgtagtcaggtgtcagcctccagaagcagcacctggtcccggacaacctgcctggaagtgtggtgcactcaggtggtaccacgggcaaagactccctgcttgggctctgaagagctccctctgcctctgaggtggtgcccccttttcgtttattttttgttgtttttttttaagagagggtcttgcactgttgcccaggctgaagtgtagtgtagccgctaactcctgggctgaaatgatcctcttgcctcagcttcccaagatgctgggtattacaggcaaaaactcatgagtgcctgagtctccttttttaagaaaatttaagcatgtagtaaaaatccagtctgaacaaacatgggaaaagtcagcctccctcctgccccccttcccgcccaggcaggccaggcagcagcagtaatgacactgactgagcggcgggcactctgttgtcctggggccgggctgagagcgctggccagggtcatctggttccaggcagtgtctccccttggccctgtgaccatcccctctgcacagcaggctgcaccagcacttatgtctccacgtcactgccctgagcgcctatctgccacccctgggccgctgccgtgggtgcagggcagcccttgctgggagggagtggggtgagctggccctgtccagcctctgtcctcgcccccaggtgcagtcggctgccctggacgagatgttccagcaccgtgagggctgcgtcccacgctaccacaaggccctgctgctcctggaggggctgcagcacatgctctcggaccaggccgacatcgagaacgtcaccaagtgtgagtgcccggctgggctgggggctggggactctgggcgtctccctcacactcccctctccctccacaggcaagctgtgcattgagcggagactctcggcgctgctgactggcatctgtgcctgacctttctggcctggctgggccccccgtcctgccgagccctgcagagtgggctctgtgtgctggctggactcctcgggacaagcccatggcgctgatcgctggtgctgagccctgccctgggccccacggacagtcagcctgccggcctccctgcagctcacggggcagaaccagcacatctggagccacacagcttggggggtgtctcccatcttttacaggtggggatcacagaatttctgcccctccagctgcctggctcagcaggcgtgggtgccaccaccctctagccccagggcagccccggaggacaggcaagggcctgagaccactgccgactcaaagccaaagcgagctcctgcttagggaaggtcagcaggcactgtgcccaggaagagcctgcggcctcggcgtcccccagtctccaggagcctctccctccgagatacccacccagctttgtcaatcacccaagcactttatgcatatagagacagaacctggacctcaccagggactgctgggcagcgattcctggcagtggcctggtgtttgtacatacacatatgcagacacatgccagggccccccaagcccgagcaccggaccacgttgctgcccaggtctggacctcagcgggagaactggctccggggggagtggggccctgcgctagaggcagaggcagttctttgttcaagcgttcctctggggaccggcagcagaggcaccgtgttctctcagccctggatacgtcttgtaatctttcacactttattcctaaaacgtgtcttatttttatgcagctcattttttctttaaaggagaaaacttgtaggtgtttaagaattggttttgggagggcgaggactgggccaggttagaggcagatggcacaggggcgtgtggcgggcgggtgaggctgctttgcacacctgtgttggtggctgtcccctgccgcccctccctgtggcagcagcaggacaggtgtgtgcccagcaccctccctacctgggcctggaagcagatgaggggaatacttcatgcaaagaaaaaagtaacatgtgcaaaagctccccgtccagctttgacagtcagttttgatgtcagctcctcggcagggtaggcctgatgacagccctgtccctccctgcctctgccttgcccaaggccacggagggcatctgcagagaggcctgccttccggattccaggcgggcatgccctgcaaaccccgcctgggcctcccttggtctgcccagccctcgattagccctgcctgaatcagtagatacttgaacgagtccccagtctgcgggaggcagtggtggggccatggacccatgcggggggttccagggtcacacgccacataacagacaaaaatacacacacgtgtgtttttctttgcaatacttgaaatattgccactgtgcttggacttagaagaagaaaatccccgtgacttcttcctcatcaccttgatggctttattctcaccttgtggggcatgtttgtatttattgcttcatggccgactggaatcctgagtcctgggaagctggcactgcggggatcttgcccggtgtcctggtcctcttgcttccgtcgcggccgcatgtgcgtgtgtccaagcaggtcctgggcgcctcaactgctgcccctggttgaatgttctcttgatagtgctggaccctttgtctattttaaagcgaattttgtgtgatttcctgccctttgcgttatattgtataataccaacgtaaggaaataaacctttggaattgttgggctggtgtca

SEQ ID NO: 420 - DNA, 15963 bp, Homo sapiens
accaactcacaaaggctgtatttattaatttatagaaacaagataaaagtgagagtgtgtgggttggttcgtttgtttgttttttgactttgcccctctctgtcactcaggctgaagtgcagtggtgcaatctctgctcactgcaacctctgcctcctgggttcaagcgattctcgtgcctcagccacccgggtagctgggatttcaggcatgtgccaccatgctcagctaattgtatttttagtagagacagggtttcaccatgttggccaggctggtcttgaactcctggcctcaagtgacctgccagcctcggcctctcaaagtgctgggattacaggcgtgagccaccgtgcccggcctagaaagaagagaaaagtcatttagacagaatgctcccaaccattgctcagtgctctcttggcagtgtagtctcctaggaagcctcgtgggtgttactggccaggaccaggtccgttctgcccatgcacagtaaattaatcactgtgacatgagttttgcaaaagactaaagatttattcacaagggtgccaagcaaggaggtaggataatagctctcaaatccacctccccgaaaataaggcttagggataagccttgcttccaagcaataaagcacagaccccagtcacactcaaggggagggggctatacaaggatgtgaataccagtctgcctgcctcgtgggcctacaacgcagaagggccatgcacttggtttaaaactttgttgttgctgtcttgacattcttaacaatttaaaaataagggtccccacattttcatgtgtagccagtcctgtccaaggagtccaaagaggtcatgagggtggacaggtcactgtctcctctgggcagtgatggggccactagcagttgttctgtagtctcctagcccctaccccagggccacaccttccccatggtctctcacattcttttttttttttttttttttttttttgagacagggtcctgctgttgcccaggctggagtgagtgcagtgctgcaaactcagcttactatagcctcgacctcctgggctcaaacaatccttctgcctcaccctcctgtgtagttcggatcacaggcacatgccaccatgcttggctaattttttgactttgtagagagggcatcacactttgtttcccagggtggtcttgaattcctgggctcaagtgatcctcccacctcagcctcccaaagtgctaggattataaagatgtgatccgccgccccggcctctctcacattcttggcatttaaagttaccgtcattgacaaggaacatgggtacactccaatttactcaagaaaaaaactcttttctccattgaagagatatgtggcctggctgcttcctactctagttgaggtcttctttttgtttcctttttcttcttctctcttgttttttagagacgaggtcctgctgcgttgcccaggctggtctcaaagttctagcctcaagagaccctcctgccttgtcctcccaaagtgttgggattacaggtgtgagccactctgtccagcctcaaactgtggtcattagatcagcagcagcagcagccttgcctgggagcttgttagaaatatactaacaggctcccacccccaaacccagacctactgaatcagacagagtctgtattttcataagatcctcagatgatccaaatgcgccttaaactttgaggagctttgatccagaacctgggctggaggcccctgggggccactctgttcctcacagactgcaaggtatgtttttttcttgcctcttctctctgtcctaatgtctccttctctctgtgtctgaccctgaggaccctatgacatcttcccaggggagtttccactgtcaaagagctgattctctctctcttttttttttttttgagacggagtttcgctcttgttgcccaggctggagggcaatggcgtgatctcggcttaccgcgacctctgcctcccaggttgaagcgattctcctgcctcagcctcccgagtagctgggattacaggcatgcatcaccacgcccagctaattttttgtagttttagtagagacagggtttctccatgttggtcaggctggtctcgaactcctgaactcaggtgatctgcccacctcagcctcccaaaggcatgagccaccatgccctactgccagaggcctgattctctagaatctgatgggctcttctagacagcaatctctacctgggctcttgttgaagaagccaatcagctcattggttggaggtcacatgatataaaacatggccatcttccaagccctatgtgtggacaacgagatagggacaagtaggcatatcacgttctgatacctggacccacatctgtcgctgggcccacgtctgtcctcaggcccccaggatatacttttatggggagttttcctcccttcccccaatgtggtcactcataactttacacccaacagtcaaacaggagtggaagctacagagtttcacgcaaacaataggctaggctgtgggactgagtaaaaggcactggactgtggtaggtcttactccaagatggccaaatggaagggcttttagctttctttgtttttgttttatatcctgagacaaaatgttcaatttctacactttagaataaaaagagccatattttatgtttcatattttttgtatgcttcctttcatactcttttgaacaatgcaatcatattttcattatgaggtataattcacataccataatatccgctctttcaaaatatactttaaaattcaattggtttaaagccaattcattggtttttagtatattaacaaagttttgtcaccatcacaattatctaattctagatcattttcatcacccctaaaagaaactctgtacccattaaacagtcactccccatttccctcttctcctagcccctggtaaccattcatctactttctacctctgtggacagtaagtatctgcctattctggacatttcattcaaatttaataatgaaatatgtgagcttttatgactggcttctttcatttaacataatggtgtcaaggttcattcatggtgtagcatataacagtacttcatcccttcctgtggctgaattatattccattttatgtatacaccacattctgtttatccattcaccagttgatggacttttgcattgattctacttttcagctattgtgaatccccatgctgtgatgaacattcacgtacaagtttttgtctggacatatgtcttcagttgtcttgggtatacacctaggaatggaattgctggataatataattctatgttggccgggcacggtggcacatgcctgtaatcccagcactttggaaggctgaggtgggtggatcacctgaggtcaggagttcgagaccagcctggccaacatggcgaaaccccgtctctactaaaaatacaaaaactagctgggcatggtggtgcctgcctgtaattccagcctgtaattccagttactcaggaggctgaggcaggagaattgcttgaaaccaggagacggaggttgcagtgagccgagatggcaccactgcactctagcgtgggtgacagagcaagaatctgtctccaaaaaaaaaaaaaacaaaaaaaacaaaacaaaactaacccatatatatataatatgttatatatacataataatatattttatatatatgtgtatatatgtttaacttttggaggaactgcaagctgttttccaaagcggttatacattttacattctcagcagcagcacacaagggtttcaatttcttcacacatcctcaacaatacttttaatctgtcttttctgttatacccctcatagagtgtgtgaagtgatatctcattgtggtttgattggcaatgtcttgattatagtatctttgtactaagttttgaaattgggaagcatgagtcctacagctttttctttttcaaaattattttgaagattctgagtcactttaatttccaaatgaattttagggccaatttgtcagtttgtgcaaacaggccaagtggaattttaatgcagactgtgttgaatttgacatcttaacattactacaccttccaatcatgaacatgggatgtctttccatttattaaggtcttctttaagttttcccccaacttttaaattatgaaaacatttaaaatccagaaaatgaaaggactagtacaacagcactaatatatgcaaccccagtttcaacttactgttttttgaacataagataccaacatcatgacaccccacctaaggactttttagcaaaacattctaatttctctactgggattattgtttgttgtcttcctccacaataatgtgagcactaaaggtagagacttttgcgtactttgttcactactgcttcctctgcaccaaaaacactgcctggttgtgggtacttttctagttttaggaaggagaagacaagatataggtcctgactctggttctgcctctcattcatatgctactccgaggatcccttccccttgaagaacttgtttcttcatctacgaaatggggataatactactactcatcagggtggttgtgaggattaaacaaggtaagagatgtaaaattgcatgttagttatcagatagttttgttttcccatctagctccatgagggagaggatttgctctagtccgtccgtctgggctctgggcttctaatgggcagacaccttcctccatgatgtttgtagctgcaaagcctggcacagtccctcaagacaagctttttgacttgaactgctgatggtcttccatgcacaattcaacagaaacccagtagcatacacttccttgtatgcacttgcccctctttttacatttattacacattcattgctacctaataatccccgatacttatcttttactttatccaattattcaacagttttcaacagaaatacctagaagagagctattccgacttcattagaccctgagattctatttttaacatttcttccatggattgttgaatgtttccaatgattgatccaccttcccttggccttatctgcattccagatttggttgtgtgtccatctctgtgttgccagacttacctcacagacccagcttgaacacaagatgggtgcttgctgaagagcaggactcattctgttgaacctgcatgctttctcaggtcagattgcttggtggtgcttctttaatttctttcaacagcacattgtagtttgctgtgtttaagtgttgcttttctttggttaaagttattctaagtattttattctttttgatgctattgtaaatgaaagtgttgttttaattttgtttttgatcctttactgcaaatgtatactattgatttttgtgtattaatcttgtatcctgcaaccttgctgaacttgcttatgagctctaatggtttttaagtgagttccttaggagttcctataatgtcatctgtgactaaagatagttttacttctttctttccgatctggattccaccttgttcctttttcttgcctaattgccctaataaatagaagtagtatgaatgaacattcttgtcctgctcttgatcttgaggggaaacactcaatctttcacaaggaatgaagtatggtgtttataggtttttcatagatgctctttgtcaggctgaggaagttcctttctagtcttcatctgttgagtaattttatcataaaaggatgttagattttgtcaaatgccttctctgcattaggatgatcatgtgactttctattaatatgaagtgctatatggattggtttttgtacattgaaccacatttgtactcctgggataaatcctacctggtcaatgtgtataatcctcttaatatgctgctgaatttgatttgctaatattttgctgaggatatttacatctatatttataaggatattgctttgtaactttattttcttataatgtgtttttctgtctttggtatcagggtaatgctggcctcatagaatgagttgaaaaatatttcttcctgttctattttttagaagagtttttgaagggttggtgtcaattcttcaagcttttggttgaattcaccagtgaagctatctggtcctggacttttctttgtagggatttcatttattgatttattgatttattttttgagacggagtctcgctctgtcacccaggctggagtgcagtggtgcgatctcggctcactgcaagctccgccttcctggttcacaccattctcctgcctcagcctcccgagtagctgggactacaggtgcccaccaccacgccccatctaatttttttgtatttttagtagagatggggtttcactgcattagccaggatggtcttgatctcctgacctcgtgatccgcccacctcagcctcccaaagtgctgggattacaggcatgagccaccgcgcccggctttttggtaggattttaaaaaaattaatattttaatatctttacttttacaggtctattcaaattttatcttccttcttaagtccgttttggtagattgcatgtttctaaaattttctcatttcatcgaggttatctcatttgttcacatacaattattcatagtatttctttataaacctttgtacttctctaataccagtagtgatgtgtccattttctttctttctggtgtctggttttttggtttttgttttttttgtttttttttttgatataaggttttcctatgttacccagactagagtgcagtggtgcaatcacagctcaatgtaaccttgaattcctgggctaaagtgatcctcccaccttagccacccaatttgctaggactacaggcgcgcaccaacacactcagctaattttttctttcttttttttttttgagacgaaattttgctcttgtcacccagggtggagtgcagcagtgtgatcttggctcactgcaactctgcttcttgggttcaagcgattctcctgcctcagcctcccgagtagctgggattacaggcgcctgccaccatgcccagctagttttttatttttactagagatggtgtttcaccatgttggccaggctggtctgaaactcctgatatcaggtgatccgcccgtctcagcctcccaaagtgctgggattacaggcatgaaccactgggccttgcctcctagctaattaaaaaaaataaataactctttttgtagaaacaagtctcactatgttgcccaggctggtctcaatctcttggcctcaaatgatcctcctgcctcggcctcccaaagtcctgggattacaggtgtgagccattgcacccatcctccactttcttggtgaataatttgagtcttattttttcacttggccattctaactaaaggtttgccaagttttgttgatcttttcaaagatccaatttttggtttctttgattttctctattgtttttctgttttccatttcatttatctccattctaatctttattatttcctgtcttctattggtgttgggtttattttgctcttatttttctagttccttaaggtgtaaagttaggttattgattgaagattgttcttctttaacttaggtgtttacagctataaattttgctcttagcactgcttctgctgcatcctataaatttgggcatgttgtgttttcatttttattcattcaagatactttttaatttcccttgtggttttgtctttgacccattggttgtttaagagtgtgccgtttaatttctatgtgcttgtgagttttctagttttccttttgttcttgattttaaactttattccactgtgtccagagaacaccctttgtatgatttcaatcttcttaaatttgagacttaggaccaaatatatgctctatactggagaatattccatgtgctctttagaagaatgcttattctgctcctgtcgggtagaacgttctgttcatgtctagtgtgtgcaattggtttacagtgcttttcaagtcctctatttccttgatggtcttctgcagtttttctattactgaaagtgggggccaggtgtggtggctcacgccccgaatccctttggggattcagggtggctcagcactttgggaggctgaggcgggcgatttgcctgagctcaggagttcgagaccagcctgggcaatacaatgaaaccctgtctctactaaaatacagaaaaaaattagctgggcatggcggcatgtgcctgtaatcccagctactcaggaggctgaggcaggaggattgcttgaacctgggaggtggatgttgcagtgagctgagatcgcaccactgcactccagcctgagtgacagagtgagactccatctcaaaaaaaaaaaaaaaaaaaaaaaaaagtcaggtattgaagtcaccaactattattactgacaacgtaatcatatttaaccctttacttttaaaattctttttggaaactggaaggatctgtaaccaccacccacttccacatcagaccctatgcatacgccaactgtctgttgctcagcagctgtgatgttgttccagttctttattaggcaaagaacagttgtttttttagcatttcctttaaggaaggtggctcagatcattgagccagccaggccctgcaggatgggctgcgattagggtcacaagtacttctcccgaaactcacagattttcctcgtgaccattggatccaatgttgaaaagtcccagtcggccaactgcattagtcgatcatgggcctccctaaagaggccacagccaatattcagctccacccgcatacgccactcagctagcttggagctgttgaggaagacattatagttggctgccatgggctgtggatagacaaagacgaagatgtggtcagcctggggaccagccccacctgggtcctctcccacagcctctggcccacgtccctaacatctacctatggaaagaattaggctgctgacccccaaggcctgagcaaggggtcacagactatgtaatagatgtaggtggggatggaggatccagaatccctcagagtcctcagtcactggtcttcttgctccaagccttctgaaccacactgagagggctcctggcccaggcagctcccacttctccagcctgcgacctcgcatgaatcctgccttcttccagggaaaccccttatcccaggtgtgtatatgcggatgagggagagaactcaggttttttcctccatgtttagactcccactatgatcaagctcaggggctaagatgggagacctggcgggcagtctaccctgcagtttcgctggctcactaagacagtctaccctgtagttccgtttgcacccaagatctttgggaagccaaagaaggggtgggtcgttggtgaaatgtaaggggtggggacgaagtatatggctgaacccttggggcaggccagaatgatttttcctggtgctggtctgccctgcaaacagaccaaagagactaattttcgtatcaaccagagatctctgcaatagggaaaagaacactgtatttcctggtcaatccaccaggatcccaggtgcctcctcctggcatatctctggctgatatgcaaattagtctctttggtcagtgtgcagtgccctagctggtgtgcaggatggccagttgagaccctggccagtgtcttgacaagcagaactggtcaccctcccctgcatgtagaggccacataaatgccccacactcaggtgtgcctccaaatgcacagtggatgcccctcagacccagccacgagagctgtcctccagagctgtctgtctggagctctgggaaacaggcagggccagaaggacacccaggaagccagtgaacatttcctggagagtccagcaagaggaggaggtatctgggatgctggtggattgagcaggaaatgcagtgttcttctctatcccaggctcaccctccgggtcctcccacaccgaagaatctttgtcaagtgtggagaactgtgatccttcctgattcataacattctgtgcttcctgttgccccgattgagtccaggcccccaggcctggttcccgcagcccccatggcagctctgcctgcctttcccgcctcaccagcctatcctcaagtgatggccccattggtcacagaggagtcctacctctgcccagggtctaaccctcctccaatccactccacacctgcatcatctccaccacggccaccaggtcagccagtgagatttggttcccggtgatgaacatcttatcctgcagaaaatactcctcaaagagctgcaggctgttcttcacctcttccactgcatgctccatcttctcagctgaaacttccttccctgttatctttgggatcagcaactggccagggttgggaagaggagggaagaggaggctgtactccagggccacctgccctgccaggtctctgtactcttgtctgctggatagatattgaacacttcccaggatataaagcagtttcacctcttttagcagttctgattggtggaaggtgccgggaaccatgcgttcacaaggatttggggagctcagcaggcataagtcctgtgattgattagtgatgccggtcacaggcatggaatttgaagtagagacacgtgtactggttatttgtcatcttccaattttcttttttcttctttttttttttttttttttttttttgagacggagtctcactctgttgcccatgctggagtgcagtggcgggatcttacctcactgcaacctccgcctgctgggttcaagaaattctcctgcctcagcctttggagtagcgtggattacaggcacatgccagcatgcctgggtaacttttatatttttagtagagatggggtttcaccctgttggccaggctgttattgaagtcctgaccttgtgatccgcccacctcggcctcccaaagtgctgggattacaggcatgagccactgtgcccggccatcttcaaattttctatgagccatttttttttttttttttgagatggaatctcactttgtcacccaggctggagtgcagtggcatgatctcggctcactgcaacatccacttccctggtttaagcgattctcctgcctcagcctcctgagcagctgggattacaggtgcccaccaccacaccagctaattttttttgtatttttagtacagacagtgtttcacaatgttggacaggtaggtcttgaactcctgacctcaagtgatccacctgcctcggcctcccaaagtattgggattacaggcgtgagcactgctcctggccttctgtgggccttttgacgctgagattctctagttcagaatgaaatgcctcgaatgctgtcctgggtgagtcacatcagcccctcccgtatgcccttcccctcgccctaataagactctttcatgcccattgtttcagtccacactcctgacggctctgtaaggcgggcaggagaaggagctgaggaaatgaggcccagagagggagggagacttgcttgaggtcgccggcagtcagcagggccagaactggcctccagccttcctgacttccctgtgcccgtgtccccaagccccagaagtggccctgctcaccttgagccagactatcttcttcatgggcagctgaaaggccgtgtgttgccaagccacgaactcatccacacgggcacgtgcgtgcgggtctggcgggcaccagtgcgatggtgcgctgtacttgcggcacaggtagtaaaggatggccgcgctgcagaaggggccggtcaggggcactgcccttgccttcctgagtgccactacatcaaccaccccggtgtggcctgggcccaactgctggggcttccagagcaaagaggagcccaaacggccccgagaaagaccttcaccagagctgtctgtctgacagtcagtaagggctgggaaggagccctgcggggtgagtaggagttgggggctggtggtataacaaagagtaggccagcagggggaacaacacgtgttgaattgggatgctgaggtgggaggatcacttgatcccaggaatttggggctactgtgagccaagatcacaccactgcactccagcttgggtgaaagatcaagatcctttttcaaaaacaaaaacgggggggcacgatggctcacacctgtaatcccggcactttgggaggccaatgggggcagatcccttgaggccaggagttggagaccagcctggccaacatggtgaaaccctgtctctactaaaatgaaaatacaaaaattagctagttgtggtggcacacacctgtaatcccagctacttgggaagctgaggcacgggagtcacttgaacctgggaggcagaggttgtagtgagccaagattgtgccactgtactccagcctgggccacagagcaagactctgtctcaaaaaaccaacaaagaaaaacacatgctgaaatacgagggtaaagggagcaaggtaaatctgaagaaaagagagtagggggttgcaactggaagaagggtgggggtgattggggagtgatgaggcagccagagacactgtggagtccacggagggtagcccctggaggtgcagggaggttatggacttaatgcttaagattaggcattatataagccagggcatgaaaggatccatctctctggtgctggatggagggtgagcccgagggggcagaatggacaatgagggggccagcaactatcgggaaggttgtggtgtctgggaatgttggaggccatggggacagagggaaggggatggaggggagacatgcttcggaggggatgtcctaggccttgctgattgatggctggtgtgggaacctccgcagcacaagggctcctttatcatcaccagcagcaaccatgccaaggtaaaaaggtcagggcatggagagagctatcggttaaaaagtggcaggagagacagcaactggctgcaagactcagaacttcttggctgggcacggtggctcacgcctgtaatcccagcactctgggaggccgaggcggggggatcatggggtcaggagatcgagaccatcctggttaacacagtgaaaccccgtctctactaaaaatacaaaaaaattagccaggcatggtggcgggcacctgtagtcccagctactcaggaggctgaggcaggagaatggcgtgaacccgggaggcggagcttgcagtgagccaagatagcgccactgcactccagcctgggcaacagagcgagactccgtctcaaaaaaaaaaaaaaaaaaaaacttctttggatcctgatccaaacaaactgccaagaaaatgtttaggagataatcatagagttttgaacaggagccacatattagatgaaatccaggaattattgttaattttatgaggtatcttaatggtatcgtagtgatgctacgctctatcctagcccaggctggagtgcagtggcgcaatcagagttcactgcagttctgaacttcctggcctcaagcgatcctcccgtgtcagcctctggaagtgctcggattataggcatgagccaccacacccagcctgttgctttttttttgtttgttttaagaactcttatctctgaaaagtatgttcctaaacatttattgatttatttacttatttatttttatttttgagatgggatctcactctgttgcccacgctgaagtgcaacgacgcagtcttggctcactgcatcctctgcctcctggctcaagcagtctttccgcctcagcctcccgagtagctgggactacaggtgcagaccaccatgctggctaatttttgtattttttgtagagatggggttttgccatgttgtctaggctaggctggtcttgaacacgtgagctcaggccatcccctcacttcagcctctcaaagtgctagaattacaggcatgagctggcttctaaacatttatgaatggaatgatggggtgtctgggaggcaggggaatagaaatgatgtaaactggaccccaagttggcaagagtcagagctgggcgatggatttgtggggttcctcgtgtccctcattagttagtattcactctcctttagtgcacgtgtgagattttccatggtcaaacagacaaatgcttgcactgaacctcccaggagaagcagagacagatggtgcaagggccccagggaagacttacctttcacttaagataaatttcccatctttgaggctgggcagcttcctgagggggttgatgtcaatgtatcctttgctgtggtggtgacctgggaggggcagggaaggtctgaggctgtgggactccaggggagagagaactgagactcccagagacccaaacgcctccctctctattttctcaagaagagggaactgaggcccggagggacattgcgtctcaccccaggtcacagggcaaggcagttgcagaaccggactgcgatcagaactgctggctcccagcctgctccaccctaggtttggtgactcccgtgcctcctacctgtgtcccaggaccaggacgacccttttacccagaagccggaggcctccagtgcccacccccaaagctggatctgaaaacacagcctttgaatcacctgaagccctgagggcctgggtcccatccgcaatcccatcgctctcactctgtctccactttaaggaagccaggcccagcacacagctggacatccaaagggaagcttctcggacacaatcagggtcatcttaacagggaacctgaggtgggggcaggaactgaaactcttcctggaccagccgcctccagttggaaacatttctgggggctccactcgcagcccgttcatttccacagcttccctgtctcttcctctgtgttctagaggcttctgcttttgcaggctgagcttttggagtccctctgtgctggggatggagttggagcccacccctctgaccctcactcagggttagtggagccctgagcctttctgaacactggggaggatgggtgtagacggactgtgcacttctgccccctttgccaacctggtgggcaggtgctgagttcacaaggtcctagaatcccacaaggaagccagggtgcctggtgggagcccagggagtcccagctactgttccttcccccttctcctcgaaaagcctgttcatctgtggcgtggggactgtcattagtgagcactgactaaggtaggctggacaaggatgcagcctacaagccgcgtggcatcttttccttccctgtggacctctggggtgattcccttgtctctgtctctgctcctcagaaacgcccctatcaggctgtgcgcggtggctcacgcctgtaatcccagcactctggaggctgaggtgggcagatcacttgaggtcaggagtttgagaccagcctggccaacatggtgaaacccctgttaaaaatacaaaaaattagctgggcgtggtggcatgcacctctaatcccagctactcgggaggctgaggcaggagacgcacttgaacccagcagaggttgcagtgagccgagatagcaccaccgtactccatgctgggcaacagagcgagactccatcaaaaaacaagaaaaaaagaaaagccgcaatctgtgtgtcctgcctccccccaggaccaggcctgccaggcagcagtgggagttgacctttcagcagatccacaaactgaaagttgaactggatgtcatgcttcttcgagaagatgtagacggcacggcagggtgctgacagcaggtccatgtagagctccagtgccatgttgagacacatgccaggccccacagccgcagttggccagccacagacctgggcctatgtctggccagagtccctggccctgtgccctctccgatct

SEQ ID NO: 421 - DNA, 45278 bp, Homo sapiens
cgtgctgggctgttcgtctcttctatgtgctgatttcctgggttactttgggtcttccttttctttctcccttttaccctgtctcctttcttgaggctgatcgatcacagccaggcctctccattctatttacccagcgttttccttctctccagttagtggggtagatgaacgccctgtgtttataaggtgcctcccaggagcctgagacctgtgagaagaatggggggtggaggtgggggagactcgtcacgaagggagaccttggagcttcgagggtgggaatgttcttattagattcttcatctctgttgacacaaacatgtaggagaagctggagaacatagacagggatgaggtaaggggggggacttcccatgaaaggtgggacccaagccctctctgctcttgtgagcttgctctctgacctagggcagaaacgtctttgatactgtaattccagaatgtgatttaaaaagaaaatcacacttctagttgactcatactaattatgtatattagctgcagagagatgtgttggtacatgtatacgtatcattaaatcagggtaatgagcatatccatctcctcatacctgtatcatttctttgtgttaggaacattcagaatcctctccttaggtgggaggagggagagggtcaggaaaagatagctatggggtcctattcttaatacctgggagatgaaaaactgtacaccaaacccctgtgacacgagtttacctgtataaccagtgtatatgtacccctgaacctaacataaaagttagaaaaaccctcgaaaataataagatattaagtatattcaacctatagtgctactgaacaccagcacctattcctacctacaggtgtaacttggtatccattagccaacctcttttcatcccccttctccaattatgccatttgtttagactatgaaacgtatatagaaagaatatttatctttctatatcaataaaagttggtttttactgttaagggttgaattgtgtcccaaccctaaaaacacacacacacacacaaagtcctaacccctttatagggtgacaaaataaggttgttgcagatgtaattagttaaggcgaggtcatactggagtgagtggcccccctaacttaatgacgggtgtccttatgaaaacggccacatgcggctgggtgtggtggctcatgcctgtaacaccagcactttgggaggttgaggtgggtggatcatctgagctcaggagtttaagacaagcctggaaaacatggcaaaaccctgtctctactaaaaatacaaaaatcagctgggtatggtggcaggtgcctgtaatcccagctactcaggaggctgaggcaggagaattgcctgaacccaggaggtggagattgcagtgtgccgagattgcaccattgcactccagcctgggtgacagaatgagactcggtctcaagctggatgcagtggctcacacctataatcccagcactttgggaggccgaggcgggtggatcacccgaggttgggggttcgagaccagcctgaccaacatggtgaaatacaaaaaattagccaactgtggtggcgcatgcctgtaatcccagctactcaggaggctgaggcaggaggattgcttgaacctgggaggcagaggttgcagtgagccaagattgcgccattgcattccagcctgggcaacaagagtgaaactccatcttagaaaaaatggccacatgaaggtagagacaagcagaatggcatgtgacaaagtcagagtgaaattacatagctgcaaaccaaagagtgacacaggttgccagcaaaccacagaagccagtaagaggcaaggaagggctcccctgggtttcagagagagcagcaccctgccaacactttgattttggacatctaggctccagaaccatgagacagtaggtttctgttttaagttacctagtttgtggtacgttgtcatgccagcccaaggaagctagtacgctattaaaagaaaaaaatgatgtgattttacacttagagaacagcttcaagaatatatccttaggatcaccaaatgttaaaagtttaccttatatggtgtccctctactcttatataagtatttttcctgatctgttcaagatttgtacacattgtacaaatttacatctaataatttaccctaaatgcttcagggtttatcttctaaaaataaaaataaaagtaagctcttttgataaccacactatataaaaaacaggaaattaatagaatgatattatctaatgtacagatcttacacttaatggactttttaatttttgcatttgttttcacaagtagaccgaacatggaaattcttacactaagcctgttttttttttttctttttttaaatttaagttttgggatacatgtgctgaatgtgcaggtttgttacataggtgtacacgtggcatggtggtttgctgcacctgtcaactggtcatctaggttttaagccccacatgcattaggtatttgtcctaatgctctccctcccctttcccacccctcacccacgggcctcagtgtgtgaatgttcccctccctgtgtccgtttgtgttcttattgttcaactcacacttctgtgtgagaacatgcagtgtttggttttctgttccagtgttaatttgctgaggatgatgtaaacctgttttcattatctaacctatgcctcagtttgagtgtgtgtgtgtgctctttcacacacatatacacacatgcttatgctctcacacacacatacccacacacatgctctctcttagattctggaaaaataatttttatttaaattttgacataatttgctgatgaagatgtttgagcctgaagtcttctgtgggggaagagttaaaaaaaaaaaaaaaagctttcaaaacttcacacacacaaaatagatgaaagttgtcattttctaagaatttatatatttgaacaaaattatcagttttattggcataaaaatggtaatagtctcaatttttgatatctgtagggtatgtagtggtgtcttctgtttctggtattaattgctcatgtcttcttattcatcagacttgttgggggttatccagtttgtattttcaaagaatctacttttgacagagtcttgtattttaatttttatttcattgattattttttctactttcttttggtgtgttttgctttttatctaaatgtataattagtttatgaattttcaaccttccttatgcctttgaagtagcacatttttccagctcctgatttagctgtatttcactcacttcatatgcaacattaaatattcagttcaaaatcttatatccgatattttctctttattcatagattacttagaagtatgtttcttaattttggaatgtccttcatttcattgtcaaattctgacttaaattatgatcagaatattctgtgtaacttatattatttgaaatatgttgaagcttgccctgaggatcagtatatagctgacattggtagctgattcgtctatcttatagtgttttttccatttattgaatgaaaaggtctgtgtccacaaggtaaaatttttccattgtttttaagccctttattttctttttaacttgtttgtttaattgctggaacaaattgataaaatatcctgctatgattagggacttacctaattctccttatggtgctgaccattgtcgggggtgtgtgtgtatagacatatgtgtatgtgtatgtgtgtgtgtgtgtgtgtgtgtgtgtgtgtgtatacatattttcttttttctttttgagacagagtcttgctctgttgcccaggctggaatgcagtggtgccatctcagctcactgcaagctttgcctcccgggttcaagcaattctcctgcctcagcctcccgagtagctgggattacaggtgcctgccaccacgcccagctaatttattattttttattttttggtatttttagtagagacggggttttaccatgttagccaggctggtctagatctcctgacctcgtgatccgcccacctcggcctcccaaagtgctgggattataggcgtgagccacagcacccggctgatcattcgtatattttaaggctgtgttattgttgcatgtatgattataattgttctctcttcctggtaatttgagccctgtggttatgcagcatctagatttctcaccaatgttttggcttggggtctgcttttctggtatcaatattatgacaacagatttttttaaaagcctggaataattcaatatcttttccttctaattcaagtcgtgcaataaatggaatggatgaagagtttggtgagtaagatgggttatcataccttacgtatgcatgacatgctattttgttcagatttcccatttaaaaatttcttaaattgacatataattgtacatatttatgggatacagtgtgatgtttggacacatatatccattgtataatgatccaatcagggtaattatcatatctgtttgtttagacacatttctttgtagtgatactcaaaatcttctagctattttgaaatatccgccacactgttatttgctttagttaccctaatttgtaagagaacactagaacttgcgctttctaactgtaagcgtgcctgttgaccaatcgctcctggtctcccgttactctcccatcccttccccagcctctagtaaccactgttctactctctacttctataagttcatctttttagattccccatataaatgagatcatatggtagttttctttctgtgcctgccttattttacctcgtgtcctccacgttcatccaggttgccacaaatggcaagatttcattattttttatggctaaataatattccattgagtatatataccacattttctttatgcattcatttattgataggcacttagtttgtttctatatcttggttattagtaatagtgctgcaggccgggtgcggtggctcatgcctgtaatcccagcactttgggaggccgaggcaggcagatcacgaggtcaggagattgagaccatcctggctaacatggtgaaaccccatctctattaaaaatacaaaaaaaagttagccgggcatggtggcaggcacctgtagtaccagatacttgggaagctgaggcaggagaatggtgtgaacctgggaggcagaggttgcagtgagccgagatcgtaccactgcactccagcctgggtgatagtgcgagactctgtctcaagaaaaaaaaggtgctgcaatagacatggaagtaaggatatctctttgacatacgaatttccttttttaaagaggtatatacccagcagtagaattactgggttatatggtaggttctattcttaattgttttagaaacctccatactgttttccatagtggttctgctaacttacattcctaccaatggtgtgtaagagttgccttttctctgcatccttgccaacatttgttattttctttagccattctaacggggtgagttaccccagattttttaggttcaaatttgcatgtttagtctttcaactttcgtttttccgttcttagttacctctttaaagagcaagtatttggtttttgtatttagtctcaccatctttgcctctgtaccattgaggcaattattctgtgtaattactaataagagttcgagttgaccatcacttttttatttaccttatctgttctaggttcctatttctgtccttctttattttttaggttagtttgtcatttttcctcttctctatttactttggcagacaaacttttttatggttatatcagaattctatcagtgggcttatcagaatttcttatcaaatttttacttctgtcatcttcccagagaagaacattagagcacttgatgtcctttttcttttttttttagatttacgtgccagctgtgataaattttaattctattttctgtctcacaagactgactctataaagcaacttgtcttctaattgactgtggcatctcttaattttcacctgcaataattttccttctctccaatggtcaattttcaaaatttcctatagtgtaagtcttctgttggaaaatttgtcatttatctgcaaatgtctacttttatttctttttattttatttttatttttgagatggagtgttgctctgtcacccaggctggagtggagaggtgcgatctcagctcactgcaagctctgcctcccgggttcacgccgttctcctgcctcagcctccccagtagctgagactacaggtgcccgccaccacgcccggctaattttttgtgtatttagtagagatggggtttcaccgtgttagccaggatggtcttgatctcctgacctcgtgatccgcccacctcggcctcccaaagtgctgggattacaggcgtcagccaccgtgcctggccttatttcttaaagattattttattctggttagacttgagtcagcagctatttgttttgagcaccttgcatggttgcttctttagtttcttctttctgtagcacctgatcaggtcagctgtcaacataatggcacaaccgttcaaataaattattgtcctccccttgccttacccccactctggaatgctttcaagattttcccttttgtgtaacttctttatgttctaatgtcattatgtttccctataatgtgtctagacatgggtttgttatttatactcttggactttattgggcttcttaattagtagattgatttttttttcattggttaatagaaacatccaggccaggcacagtggctcacacacctgtaatcctagcagtttgggaggcagaggcgggtggatctcctgaggtcaggagttcgagaccagcctggccaacatggtgaaaccctgtctctactaaaaatacaaaaaattagccaggcgtggtgatgggcacctgtgatcccagctgctcaggaggctgaggcaggagaatcacttgaacctgggaggtggagtttgcagtgagctaagattgtgccactgcactccagcctgggcaacaagagtgaaactgtctcaattaaaaaaattataaaaagaaacatcctagtagcaatcttatattaggttggtacaaaagtaattgcggtttttgcatttttttcatggcaaaaaccacaattacttttgcaccaacctaataaaacatactacatctggtccacagtctcttttctccttttggggagccagtaacaagtgttagcccttttcatccttagtctcttgtcctctcttctgtgcttttcatctttttatctctctcttcttggatgacttctctttacgtgtcttctagaccactaattatctctgtcaaatctgatactaacacattgtattagcttcctggggctgctgtaacaacataccacaaaacagacagcttaagcaacagaaacttactgtctcacagttctgaaggctaataagtccaaaatcaaggtgctggcaggcgtaatttcttctgaagactgtgagggagaatcagtttattcctctctattaacttctacttgctttaggtgtgctttggttagtaagtggcattttccctgtggcatggtatcctcttccctctattcatatgtgtccagattttcccctttcttttttctttttatttttcgagatggagtctcactttattgcccaggctggagtgcagtggcatgatctcagctcactgtaacctcccgggttcaagcaattctcctgcctcagcctcctgagtagctgggaagacaggcacataccaccacttggctaagttttgtatttttggtagagatgggattttaccatgttggccaggctggtcttgatctcctgacctcaggtgatccgcccaccttggcctcccaaagtgctgggattacaggtgtgagctactgtgcccggccagattttcctctttcaataaggtcaccaattatattggatcgggggcccaccctgctttagtatgacctcatcttacatgttccagtacagctaattgcatctgcaaggatgctatttccaaacaagcccagacttcagttgcactttgtgacctccagtgtaactcattgtatctacgagtatgctattttcaaaaacttcatacttcagcatgtaacttttgcagggggacatacattggatgcagaaaagagtccctggtgatttttgtggtggtagtggtggtagaggagtgtgtgtgcgtgtgtgtatgcatgtgtgtgtgtgtttgggggaatatttaaagttccatctgtagccaatctgaatgcagtctttcccctcactttcagaggatctcttcccagagccggaggtattaatatttcagcctgtggcaagaggctacacttttttttaattattatactttaagttttagggtacatgtgcacaacgtgcaggtttgttacatatgtatacatgtgccatgttggtgtgctgcacccattaactcgtcatttagcattaggtacatctcctaatgctatccctcccccctccccccaccccataacagtccccagtgtgtgatgttccccttcctgtgtccatgtgttctcattgttcaattcccacctatgagtgagaacatgcagtgtttggttttttgtccttgcaatagtttgctgagaatgatggtttccagcttcatccatgtccccacaaaggacatgaactcatcattttttatggccgcatagtattccatggtgtatatgtgccacattttcttaatccagtctatcattgttggacatttgggttggttccaagtctttgctattgtgaatagtgctgcaataaacatacgtgtgcatgtgtctttatagcagcatgatttataatcctttgggtatatacctaataatgggatggctgggtcaaatggtatttctagttctagatccctgaggaatcaccacaccgacttccacaatggttgaactagtttacagtcccaccaacagtgtaaaagtgttcctatttctccacatcctctccagcacctgttgtttcctgactttttaatgatcaccattctaactggtgtgagatggtatctcattgtggttttgatttgcatttctctgatggccagtgatgatgagcattttttcatgtgttttttggctgcataaatgtcttcttttgagaagtgtctgtttatatcctttgcccactttttgatggggttgtttttttcttgtaaatttgtttgagttcattgtagattctggatattagccctttgtcagatgagtaggttgcgaaaattttctcccattctgtaggttgcctgatcactctgatggtggtttcttttgctgtgcagaagctctttagtttaattagatcccatttgtcaattttgtcttttgttgccattgcttggtgttttagacatgaagtccttggccatgcctatgtcctgaatggtaatgcctaggttttcttctagggtttttctggttttaggtctaacatgtaagtctctaatccatcttgaattaatttttgtataaggtataaggaagggatccagtttcagctttctacttacggctagccagttttcccagcaccatttattaaatagggaatcctttccccattgcttgtttttgtcaggtctgtcaaagatcagatagttgtagatatgcggcattatttccgagggctctgttctgttccattagtctatatctctgttttggtacactctgatcttgacactgtctccacatcaagaaaagtccaactctagttgcctgcttctccaagatggtctcagagcaaagcaccagcaatgttcttgcccaaagtcattctttaagtcagtggttttcaaatctgggcatgcgtcaaaattaactgacattatatataactgatgttatataacagatatataactgatattatatatctaatatcatcactaactatttgcccaaaattaacagatggctgtgccctaccctcagcatttagtgtgtctagggaaggacctggggatttgcatagcaagttaccagttggtgctgatgttccttggagaagtattgccttaggtgctcagtggtggcctcaggactcagatacatgttcctataattaagattttactaaaagtaggctttttaagactattggcaaaagcacgcaggggagaagccatgaaggtcacctttccatcatcatattctcattccgaatactgcttaataattttccctaatttttgtgggttttatttatttattttgagacagtcttgttctgtcacccaggctggagtgcagtggcacaatcttggctcactgtaacccccacctcccaggttcaagagattctcatgcctcagcctcctgagtagctggggctataggcgcctggctactttcccctaatttttggatcttagatgctattaaattttttttaaatttttctccaaattacctattttatttgaggggggggcagcaacattctgcctaatggccacccatgaataaaacagctttatttttattttccactgtataacttaacccttttattgactttgctattgatctctaatttcattgcccttaagacaaagaagatgactttgctactgttggctttttgtttttgaattatgatttcctttaaagctcagagcataattgattatcatgagcataattacaagctaattgattatcatgaatgttccacgtatgcttgaaaagaatgttctcttgtgtgtaggattccataaatattcataaaatgtgttgatttttatatatctaatatgaataactatttgccctatgtttttagtatcttttaaaattttagacttgttttagacacagaaaagtttgcaaaaatagtgcagagagttcccataaatcctgtgccacatttctctagtaacgactttcgttaccatggtacatttgtcataactaataaaccagtattaatagattattaactaagattattctttcttcagattcccccctttttacctaatatccttttttttttttttttgagatggagtctcgctctgttgcccaggctggagtgcaatggtgcgatctcagctcactgcaacctctgcctcccgggttcaagtgactctcctgcctcagcctcctgagtagctgagactacagacacctgccaccacgcccggctaattttttaatatttttagtagagatggggtttcaccatcttggtcaggctggtctcaaactcctgacctcgtgatctgcctgccttagcctcccaaagtgctgggatgacaggcgtgagccactgcacctggcccctaatatcctttttatgtgcctggacctcatctaggatcccccactgggtttcattgctgtgtctccattgagttctctaaactaggaccactctcaggatttccttgttttcagtgatcttgaacgttttgagaagcactggtcaggtatttgtgggacatcattcatgttgggtttgtgtgacgtttatctcattgcgagactggggctttgaggaggaagaccacgaaggaaaggtgcccttcccatcatatcatatgctaccacttgctacccatgttggccttgatctcctagcttaggtgtctggctggtttctccactctgaagttaatccctacccctttttatactatagtattgtatactatactatacgatactatagcatactatactatacattgagatggagtctcgctctgtcgccaggctagagtgcagtggcacgatctcggctcactgcaacctccacctcctgggttcaagtgattcccctgcctcagcctccagagtagctgggattacaggtacccaccaccacatccggctaattttttgtattttagtagagatggggtttcaccatgttggccaagatggtctggatctcctgaccttgagatccacccacctcggcttcccaaagtgctaggattacaggcgtgagccaccatgcccggctgtactatattctttaaaaagaagtctctatgtacaacccacatgatacggtttggctgtgtccccacccaaatctcatcttgaattgtggctcccataattcccacatgtggtgggagggacccggtgggagatacttgaatcatggggatggtttcccccatactgttctcctagtagtgaataagtctcgtgagacctgatggttctataaggggaaacccctgtcgtttggtcctctcttgtctgccgccatgtaagatgtgccttttgccttcccccatgattgtgaggcctccccagccacatggaactgtgggtccattaaaccacttttttctttataaattacccagtcttgggtaatgtctctatcagcagcatgagaacagactaatacaccacacttaagaggtggggagttatgccgcatctccttaaaggggaagaatccatccatctaagctacttggaattcttcttcttgctaaagttgttacagttttagctattggaggctctttcagcctgccctgggtttctttggttaggaagtggtcttagaaaccaagagctgatctggacactgggtgtatcgattgccactagggtatctgttatgcttccaggcccttgcatgagtgtgactgtaacagtaccgtagactaagactatacttccagggatcatttctatagttcactgcaaaatgctgcagactggatggcttaccaacagaaatgtacttcctctagttctggaggctggaagttcaaatcaaggtccagcagagtcccttcctgatgaagactttctggattgtacacagctgccttctgtgtccccacataatagagtcagaggaagagatggggagaaagagagccagggagggacttccagttgttccagcaccatttatggaagagacgatctgcctccattgtgcctttgtcaaaatgagttggctacatttgtggggcatgccttctctattgtttactgagaaaaatgtaatttctatatttacagtgtaatttctatatttaaaagtaaaaatgtaatttctgtagctgcggtgtaatttccaaagctgcggtgtaatttccaaagctgcggtgtaatttccgaagctgcggtgtaatttccgagactgcggtgtaatttccgtggccgcggtgtaatttccgtggccggcggtgtaatttccgtagccgcggtgtaatttccgtagccgcggtgtaatttccgagactgcggtgtaatttccgtagctgcggtgtaatttccgagactgcggtgtgatttccgagactgcggtgtgatttccgagactgcggtgtgatttccgtagctgcggtggaatttccgagactgcggtgtaatttccgtggctgcggtgtaattaccgtagctgcggtgtaatttccgtggctgcggtgtaatttccgaggctgcggtgtaatttccgtggctgcggtgtaatttccgtggctgcggtgtaatttccgtggctgcggtgtaatttccgtggctgcggtgtaatttccgaggctgcggtgtaatttccgaggctgcggtgtaatgtccgtggctgcggtgtaatgtccgtggctgcggtgtaatttccgaggctgcggtgtaatttccgaggctgcggtgtaatttccgaggctgcggtgtaatgtccgtggctgcggtgtaatgtccgtggctgcggtgtaatgtccgtggctgcggtgtaatttccgtggctgcggtgtaatttccgaggctgcggtgtaatttccgaggctgcggtgtaatgtccgtggctgcggtgtaatgtccgtggctgcggtgtaatgtccgtggctgcggtgtaatgtccgtggctgcggtgtaatttccgtggctgcggtgtaatttacgaggctgcggtgtaatgtccgaggctgcggtgtaatgtccgaggctgcggtgtaatgtccgtggctgcggtgtaatgtccgtggctgcggtgtacttcccgaggctgcggtgtactttccgaggctgcggtgtacttcccgaggctgcggtgtaatttccgaggctgcggtgtaattcccgaggctgcggtgtaatttccgaggctgcggtgtaatgtccgaggctgcggtgtaatttacgaggctgcggtgtaatttacgaggctgcggtgtaatgtccgtggctgcggtgtaatgtccgaggctgcggtgtaatgtccgtggctgcggtgtaatgtccgaggctgcggtgtaatgtccgtggctgcggtgtaatttacgaggctgcggtgtaatgtccgtggctgcggtgtaatgtccgaggctgcggtgtaatgtccgaggctgcggtgtaatgtccgaggctgcggtgtaatgtccgtggctgcggtgtaatgtccgtggctgcggtgtaatgtccgaggctgcggtgtaatttacgaggctgcggtgtaatgtccgtggctgcggtgtaatgtccgaggctgcggtgtaatgtccgtggctgcggtgtaatgtccgaggctgcggtgtaatttacgaggctgcggtgtaatttacgaggctgcggtgtaatgtccgtggctgcggtgtaatgtccgaggctgcggtgtaatgtccgtggctgcggtgtaatgtccgtggctgcggtgtaatgtccgaggctgcggtgtaatgtccgaggctgcggtgtaatttacgaggctgcggtgtaatttacgaggctgcggtgtaatgtccgtggctgcggtgtaatgtccgaggctgcggtgtaatgtccgtggctgcggtgtaatgtccgtggctgcggtgtaatttaccgaggctgcggtgtaatgtccgtggctgcggtgtaatgtccgaggctgcggtgtaatgtccgaggctgcggtgtaatgtccgtggctgcggtgtaatgtccgaggctgcggtgtaatgtccgaggctgcggtgtaatgtccgaggctgcggtgtaatgtccgaggctgcggtgtaatgtccgaggctgcggtgtaatttccgaagctgcggtgtaatttccaaaaatgtaaagtctatatttgcctggatattgaggctatgtcaggtgactataggattcttgtatcttctggattattgtatctctgattcccccatccattattgagactttcatgaccatttgaatgagaaggtgagatgaatgtaattaaataactttccgccttcattgccatccccccagtactagcaagatactatataatggtaatcttgatccatttatttgtaataacttggcactgtcctgaattttctacaggttttatttatttattgttcctggtcactgtctctttgaggattggtatctctgctccagaaaagatggcagcctctttcttctctgattttggtcttatgtggtatctggaggagctcaaaaaggaggagttcaggaaatttaaagaacatctcaagcaaatgactttgcagcttgaactcaagcagattccctggactgaggtcaaaaaagcatcccgggaagaacttgcaaacctcttgatcaagcactatgaagaacaacaagcttggaacataaccttaagaatctttcaaaagatggatagaaaggatctctgcatgaaggtcatgagggagagaacaggtgagggagtctgggaagggggaagccttcttataatgaggactatgtcctaattttggtgagtggtctctgcctgtctacaacaggacctgaatgtgctatgggaaaatattaggtttttttttttttttttttggtagacggagtcgcactttgttgcccagacagtgcagtagtgtgatcttggctcaccgcaacctccacctcccaggttcaagtgattctcctgcctcagcctcctgagtagctggaattacaggcgcctgccaccatgcctggctaatttttgtatttttagtagagatggggtttcaccatgttggccaggctggtcttgaactcccaacctcaggtgatccacccatcttggcctcccaaagtgctgggattataggcatgatccaccatgcccagcctgaaaatattgtccttgtaggcaggaaatggtctcttagacgtggtggttacatgtgggtaaaatgtcagtggctattatgtcctaacctgtattgtacctttatctgggtcaccaatgatttttaccctaagctgagaacttgcagtcaagccagaaactctgtgaggtgaagtcgttgcataagaactatgcacctgacttatttgcaagagcaattaacacctgcggtagaggatacagtgaactgaggttgactggtgtaatcatgtatttagccaaagttcacatcagacaagcaatgatctataagcaatatggcttttagagtcacatttgtatttatcctggcataaggtgttaactgttactttgcacatttgcgttatcaatggcaggatatagctctttcaactttactgccaaattgtttttctttgttgttgttcagtgtcttactgtgatgtgcctggatgtggctttgttttcatcctgattgggattctttaatattcttgcatctgaggttcagtaactttcttcagttctcaattttagccattgtctgtgtattccattcttctgtttattcttctgggactccagttacacctactggactttcttgtttgtttgacacagggtctggctctgtcacccagggtggagtgccgtggcatcatcacggctcactgcagcctcaacttcctgggctaaatgatctgccacctcagcctcccaagtagctgggactacaggtgtgtgccaccacgcttggctaattgcacacctggctaaccttttaaaaaaaaattgtagagatgagctctcactatattgcccaggctggtctcaaactcctgggctcaagtgatcctcctgccttggcctcccaaagtgctgggattacaggcctgagccaccatactggcctagactcactctttctttctctttctcttttcctttttctttctctttctctttctctctctctctctctttctgtctctctttctctctctctctctttctctttctttcttgctgtctctttctctctctcgttctgtctttctctctcttcctctctctttctctcttgctatctctttctctctctctctctctttctctttctttctctttctctttctctctctctttctgtctttctctctatttctctctttccttctttctttcttctttgatacagagtcacgctctgtcgcccaggctggagtgcagtggtgcaatctcggcccactgcagcttccacctcctgggttcaagtgattctcctgcctcagcctcctgagcagctgggatttcagatgcccgccaccacacccggctaatttttttgtatttttagtagaaacagggtttccccatgttggccaggctggtctcgaactcctgacctcaggtgatctgcacacctcagcctctctaagtattgggattacaggcatgagccaccatgcctggccttgatttcttaaatttagttcacatgttttatttatgcagtttgcctttttcacagacttccattttttctcaatatttattccatcttctattttattgagcattttaaattattttaaaatttgcctgaagattttaacatttataggtctgtttctactgtttctttttctctttatctggtcatacagtctcctagtatgtccggtaattttgagtgccagattttgaatatgagacattgaaaatgttaagaatctgtaatatcttgttccagtgaaattggaattgattctggtagtagttacagggaaatttccttaatattgaggattaaaataattggtttgaaataaaataatttgagagtttccatttttggcgatgctagcctttcttgctcattttcttgatttggaacatcacttggaaaaaacccctcccagtccaatttttttttctttgagacggagtttcactctttcacccaggctggagtaaagtagcatgattttggctcactgcaacctcactgaaccccccaggttcatgcggttctcctgcctcagcctccggagtagctgggattataaggcgctcaccaccacgcccagctagtttttatatttttagtagagacgggattttgccatgttggccaggctggtgttgaactgctgacctccggtgatccgcccgccttggcttcccaaagggctaggattacaggtgtgaaccaccacacctggccacccagtccaaatttttaaacaaattcccccatgtttcctggagtgttttggtgtcacacgctgaggtctcagctaccctggaagctgaggcaggaggatcacttcagcccaggaggatgaggctgcagtgagctgtgtttgtgccactgcactccagcctgggtaacagagtgagaccctgtctcaaaaaagtaatttatataaagaagaacattctttgcacatggaaccattttagaatattgctaaaataaaatgtaagcaggtctaaagttagatcttccactgggtacttacacttctctcttttcacagttggtttgaggttgtacccacttaattccccttatgagcaaccaaacatgtcaccgaaatctccagaacagctgagaagaccaggaaagcaggaagccattggggaatgggcaaacaacttagcttaagatgctaataggatcttcaccaatgtcagatggcattttcaccagttagggacttcaggggactgaaagattgggggaatcccttgttctccccaaaaacttaaggtagcattacctactgtcagcagtctgtgggcactggattatatctttcacctgcatccaatcaaatccagtaactattatgcggggcatagggaaaatttcccatctacaactgccccctacatctccagtccatcagcagctactcacttgcagaatataaacatcgtactagttatttaaggaacagataactgtaaaggagttttcggcctggctgaaggatcagcctctaggctggtgctccagagatgactgtaagaactatagtatcagggagctgctgcctctcctgcaaagaggaaagtgggagatgggaagctcactgttagaactgtggctttagaaatacaccacgacagctatgattcagaaatcgggaagctcaccagtgtagcagctgcttaaaatcaatgaccacagcaactggttttagttttcgagacagtctcgctctattgccagggctagattacagtggtgcaatctctgctcactgcaacctccacctcccaggttcaagcgattcttctgccctggcctcccgagtagctgggattataggcctgtaccaccacgcccagctaatttttgtatttttagtagagatggggtttcaccatgttgaccaggctggtctcgatctcctagcctgaagtgatctgcctgcctcagcctcccaaagtgctgggattataggcgtgagccactgcgcccagccaactacagcaactggagacaagccttctgttacagaagagtccagcgtctgtgtgttcatggaagctggcagcaaaacaggcagaagatagactccactccccttccccttccagtgtcatgagagtgagggccaatcgcagaacttaatctgtaccttgatcttagctacgaggggttgtgggatgcgtagggcttggtcatcactgttgctggatcttttttttttttttttttttttgagacggagcctccttctgttgcccacgttagagtacagcagtgccatctcagctcactgcaacctctgcctcccgggttcaagcgattctcctgcctcagcctcccaagtagctgggactacaggcacacaccaccacgcccggctaatttttgtatttttagtagagacagggtttcaccatgttggccaggatggtcttgatctcttgacttcatgatctgcccaccttggcctcccaaagttctgggattacaggcatgaaccactgccccggcctgttgttggattttttgattggcttttcttttgagaattctgccattgaaagaaagctcactggcataaagttggaatggatgcgaggtgccattctatcctctctactgcatctcctctctcttctggaggcaactgcctaggtcaggtcctttttaggtggactttcagatctagtccctatatgtgaaacctatatgtgtatataaatcccttgtttatgcaaattgagtacatgctatagacaccgtcctgttgcttatccatatgaagagattattccatacttttaatatttgtataatagcttgtgtctcataaattatttaactggtcttgatagtcatatagctattttccatttattttgctatcatcgtagcaatgaatacctgtgtatgtgtctattgaaagcagaagttgtcaaactttacatagtagcaatgaatgtatatgtgtgtgtgtgtgtctattgaaagcagaagttgtcaaactttacgtagtagcaatgaatgtgtgtgtgtgtgtgtgtgtgtgtgtgtgtgtctattgaaagcagaagttgtcaacctttttgtgtagaggaccatatggtttccattttaggctttgtgagtcatacggtctctcatagctgttcagctctgctattcaatcaggaaggctcctgtagacaatatacccgtgaatggtgtagtgagttctaatgaaactttatttacaagaggagactgaccaggtttggcctgggggccacagtgtgtagacccctggaaagatacatcctgagaagaaaaaaagaatatatgcaggaatgcttaactttgtgggttttctctcctcttgccctcactgactcaggatacacaaagacctatcaagctcacgcaaagcagaaattcagccgcttatggtccagcaagtctgtcactgagattcacctatactttgaggaggaagtcaagcaagaagaatgtgaccatttggaccgcctttttgctcccaaggaagctgggaaacagccacgtacagtgatcattcaaggaccacaaggaattggaaaaacgacactcctgatgaagctgatgatggcctggtcggacaacaagatctttcgggataggttcctgtacacgttctatttctgctgcagagaactgagggagttgccgccaacgagtttggctgacttgatttccagagagtggcctgaccccgctgctcctataacagagatcgtgtctcaaccggagagactcttgttcgtcatcgacagcttcgaagagctgcagggcggcttgaacgaacccgattcggatctgtgtggtgacttgatggagaaacggccggtgcaggtgcttctgagcagtttgctgaggaagaagatgctcccggaggcctccctgctcatcgctatcaaacccgtgtgcccgaaggagctccgggatcaggtgacgatctcagaaatctaccagccccggggattcaacgagagtgataggttagtgtatttctgctgtttcttcaaagacccgaaaagagccatggaagccttcaatcttgtaagagaaagtgaacagctgttttccatatgccaaatcccgctcctctgctggatcctgtgtaccagtctgaagcaagagatgcagaaaggaaaagacctggccctgacctgccagagcactacctctgtgtactcctctttcgtctttaacctgttcacacctgagggtgccgagggcccgactccgcaaacccagcaccagctgaaggccctgtgctccctggctgcagagggtatgtggacagacacatttgagttttgtgaagacgacctccggagaaatggggttgttgacgctgacatccctgcgctgctgggcaccaagatacttctgaagtacggggagcgtgagagctcctacgtgttcctccacgtgtgtatccaggagttctgtgccgccttgttctatttgctcaagagccaccttgatcatcctcacccagctgtgagatgtgtacaggaattgctagttgccaattttgaaaaagcaaggagagcacattggatttttttggggtgttttctaactggccttttaaataaaaaggaacaagaaaaactggatgcgttttttggcttccaactgtcccaagagataaagcagcaaattcaccagtgcctgaagagcttaggggagcgtggcaatcctcagggacaggtggattccttggcgatattttactgtctctttgaaatgcaggatcctgcctttgtgaagcaggcagtgaacctcctccaagaagctaactttcatattattgacaacgtggacttggtggtttctgcctactgcttaaaatactgctccagcttgaggaaactctgtttttccgttcaaaatgtctttaagaaagaggatgaacacagctctacgtgagtccatcctatgactttttctctcttctcagaatctgtctgtattcccaagtgggttttgctgagggagtgtttaatataggatcatggttagaaactcattttttctgccacaaaacctcagctcacatcctggcccaacattttaggagctcttagactttgtctgtgagccttgcccttttgtggctgcagtggccccattacagaagggggaataataattgtattgtgaggagtgaatatgaggacctgtgtgaagagtgtttcctactttctcaagtattagctgatcagtactataatcgatatttttccatagcaccacactccctgtgtcttgacctctcagctgcaagttacctttgaaaacttagtctaaaaaatcatacagcccgggtgtggtggctcatgcctgtaaccctaccactgtgggaggctgaggcaggtggatcacttaaggtcaggagttcgagactagcctgaccaacatggtgacacctcgtctccactaaaaatacaaaaattagccgggtgtgtagcgcacacctgtaatcccagctacttgggaggctgaggccggagaatcacttgagcccgggaggcagaggttgcagtgagctgagatcgcaccactgccctccaggctgggtgacagtgagactctcatctccaaaaaaaaaaaaaaaaaaaaaaaaaacaaaacacaaatcatacaaattttcttcttgttctttttttttttttttctgaaatggagttttgctttgtcacccaggctggagtgcagtggcgagatcttggctcactgcaagctccgcctcccaggttcacgccattctcctgcctcggcctcccgaatagctgggactagaggggcccgccaccacacccagctaattttttgtgtttttagtagagacagggtttcaccgtgttggccaggatggtctcgatctcctgacctcgtgatctgcccacctcggcctctcaaagtgctgggattacaggcgtgagccaccgtgcccggccaaatcatatacattttaacttacagctcatgcctataaccccaacactttgagaagctgagcaggaggatgcttgaagccagggggctaagaccagcctgggaaaaatagcaggaccccacttctacaaaattttttttttaattagccaggtgtggtggcatgtgcctgtagcacagctacttgagggaggctgaagcaggaggattgcttgcttgagcccagaagtaagagactgcggtgagccatgatcgtgccactgtataacccagcctgggcaatagagcaagaccccatctcaaaaaccaaaagaatcatatgaggtggatcctattatcctgttacaggtgaggaaactggggcaaagaagtcaagtgagctggatcctatccagtcaaggatcctgtatttaggacatggagagttttagggctgagcctaggctgaagatgtcgacttaatggctgggctgtgctgcctcatcttttactgtaaaccagcctgaccaacatggcgaaaccccgtctctactaaaaatacaaaaattagccaggcatggtggcacgcacctattatcccagctactcaggaggctgaggcaggagaatcgcttgaacctgggaggtagaggttgcagtgagccaagattgtgccattgcactccagcctgggcaacaagagtgaaactccatctcaaaaaataaacctattttggatgtgagacagggtttctcagccttggcactggtgatgttttgggggctggctctcctgttacagtggggggctctcctgtgcattgtaggatgttcagaaacatccctggtctgtactcactagatgccagaagcacccctcccttaagctctaacatccaaaaaggcctctagacatccccaaatgtcccctggggggaaacgtcaccccaggttgagaaccactaacataaggtgacttacctgaagggtcccgttccttctgactgagggaggctctgcctcagacatcttctgtttgagaagacagcgtagtgcgtatatgtgttacaagtggctcgtgttgaccgcctgcctgtggaaagctcgtcctttcttgaccacaggtcggattacagcctcatctgttggcatcacatctgctctgtgctcaccaccagcgggcacctcagagagctccaggtgcaggacagcaccctcagcgagtcgacctttgtgacctggtgtaaccagctgaggcatcccagctgtcgccttcagaagcttgggtgagttgagaatcgacttcgactcgagtatgtcacggagatgacctattcatctcacctctagctttcagtcgaggctaactgcacaagcaaagaattaacatccagagcagttgctcaacctcagcacttacagacatctcatgcagatcattcttcatcataggggttgttctgtgcgttgtagggtgttaagatgcatccctggtctctaccctctagatcctaatagcatccccttgtccagataaccaaaatagtgtccagacactgccagctgtcccttgtgggggcaaaatctctcaagttgagaactactgagctgtgtcattgggctgtgaaatcagagaatgagttcatgatggatgatgagagacaaacacaggtgtgcaggctgtgctcccattagatgaaactcatccaaaattttctttgtttttgcagaataaataacgtttccttttctggccagagtgttctgctctttgaggtgctcttttatcagccagacttgaaatacctgagcttcaccctcacgaaactctctcgtgatgacatcaggtccctctgtgatgccttgaactacccagcaggcaacgtcaaagagctagcgtaagtctccgtttattgagaccactgattgggtttcagagaagactatagcctaagtctccgtttattgagaccactgattaggtttcagagaaaactatagcataagtctccgtttattgagaccactgattgggtttcagagaagactatagcgtaagtctccgtttattgagaccactgattgggtttcagagaagactatagcgtaagtctccgtttattgagaccactgattgggtttcagagaagactatagcgtaagtctccgtttattgagaccactgattgggtttcagagaagactatagcgtaagtctccgttattgagaccactgattgggtttcagagaagactatagcgtaagtctctgtttattgagaccactgattgggtttcagagaagactatagcgtaagtctctgtttattgagaccactgattgggtttcagagaagactatagcgtaagtctctgtttattgagaccactgattgggtttcagagaagactatagcgtaagtctccgtttattgagaccactgattgggtttcagagaagactatagcgtaagtctctgtttattgagaccactgattgggtttcagagaagactatgtatttctttttgtgttgggggagggggctgcatatttgaagacatccactttttccttctatgatttgtatgcaaacttagtttcctgagaacttggatagggaagttaaagtttcccaattgatgtagccatttcggaaaactgtgtgtattcagccttcatggattctggcagattatgtaacccaataattccacctggaggtgcacattcgacagagggacctgtctcagtttgctgaaagacaggcactaaagcattcccagcaggtgttcataatctctgagaagtggaaataccactgacagtaagttggataagaaacctgtggttacatgctcctgttccatgagaaagaacactctcggtcgtatgcaaaaacctggacaaatctcagacattgttgatggcaatgagccagactcaagagtacatcctatggctttattcctgtgaagttcaaagatggacaaggctctggtgttggaggttcgggcagtgtattcacacgttctcgcgctgctataaagacatacctgagactgggaatttataaataaaagaggtgtaattggcttatggttctgaaggatgtacaggcttctgcttctggggaggcctcaggaaacttacaatggtggcagaaggcaaagggaaagcaggcacgtcttacatgggggagcaggaagaagagagaagagggaggcgctacacagttccaagcaaccaggtcgcgtgaggactctgtcacaggaacagctctaggggatggtggtaaatcactagaaaccacccccatgattccgtcaccccccaggcccctcctccaacactgggattacagttcgacgtgagggttgggtggggacacagccgaaccatatcagacagcggttacttttgttaagatagtgaaggagaggggtacaggagaatgatgaacctgctctgtttcttgacctggatactggtaactcaagtgccttaaattcatgacagtgcgttggctggcacttaaccattgtgtgtactttccagtatgtatgttttaattcaagcatttttatttttgcaattaaataagggtttcctgtaaatacttaccctctacttaccttcattggtacccacacattcaaatacttctctatactagtctttgttggccatttttctgagcttgcatcaaccgaacacaaaaagacccaaacccttttttaaaaaataacaactttattgtgatatccacataccacaaaacatatacttttaaagtatgtacttcatatattttaagaaatacttttaaagtataactatgctttaaaatgtacagtttagtgatcctcatatatattcatgaggaagtacaaccatcatgactgattttagaatgttctcattacctcagaaagaaaccccatacccattagcattcactcctcactcccttatctctctggtccctgggaattactaacatactttcagtcctattggattttcctatcccaggcgtctcatgtaagttgaatcacatgtggtcttttgcgaatggcttactttcacttagcaaaatgttttcaaggtttatccaaattgtaccatgtatcagtacttcattccttttcttggctaaatagtattccactgtgtagatattccccattttgttcttctagtcctctagtgatgaacacttgggttgttaccaccttttagctattctgaatagtgctctatgaacactcatgtgtgaacacctgctttcaatccttttggacttgtaaccaggagtagacttgctaggtcatatagtaaatccatatttaactgttagagaaaccaccaagttattttcctcagtgactgcacaattctgtattcctaccagcaatgtatgagagttctaatttctccacatctttgcttattttttacttatttacttatattttattattacttatatttacttattttttattatacccatcctagtagatgtgaaggagcatctcattgtggttttgatttgcttttcctgaatgactaatgatgagcatcttttcctgtgctttttgatcatttctatatcttctttggagaaatatatattcaagtccttcacacatttttaaaaacttttattttacattcaggggtacaggtttttaaacatttaaaaattttaacatttaaacaacattttaaaaaacttttattttacattcaggggtacaggtttattataaaagtaaatggcacgtcatggaagtttggtgtacaaattatttcgtcacccgttaataagcatagtacctgataggtagatttttcttccccaccttcttcccaccctctgctctcaagtaggccctggtgtctgttgtccttttcttcatgtctatatgtactcagtgtttagcgtccacttataagtgagaacatgtgatatttggatttatgttcctgtgttagtttgctaaggataatggcctccagctccatccatgttgctacaaaggacatcatcttactcttttttatggctgcatagtattccatggtgtatatgtatcacattttctttatctagcccactgttgatgggtatttaggtgaatagtgctgtgatgagcatacaagtgcaggtgtctttatagtacaatgatttatattcctttgggtatatacccaataatgggattgctgggtttgatggtagttgtgtttgaagttctttcagaaattgccaaactgctttccataatggctgaactaatttacattcctacaaaaatgtgtaagtgtacacttttctctgcaacctcaccagcatatattatttcttgactttttttaataatagccattctgacctgtgtgagatggtatctcattgcagttttgatatgcatttttctaatgattaatgagcatttcttcatatggttgttggcaacacctttgcacatttttaattggattttttgcctttttgtcaagttgtaagtgttctttatgttttctgattacaagttatatacgagacgtactttgtgaatattttttgccattctgtgagttgtcgtttcactttcttaatggtgtcctttgaagcacaaaagcttctaatctgatgagatgcactttatttttttcttttgtctcatgtgcttttggtgcaattgctacgaaaccattgcctaacccaaattcattaagattaacttctttgttttcttttctttttttttcccccaaatttgagatgagtctcactctgtcacccaggctggagtgcagtggtacaatctcagttcactaaaacctccgcctcctgggttcaagtgattcttctgcctcagcctcctgagtagctgggactacaggtgcccaccaccatgcccagctaatttttgtatttttagtagagatggggtttcaccatgctggtcaggatggccttgatctcttgacctcatgttccgccctccttggcctcccaaagtgctggaattacaggcttgagccaccacgcccggccgcaccaacctatatcttaaatctagaaagaacattaaaagcatgcatggcctcagagccctgctgcagaggcgtgaggagccatggactcggtgacttgccaattccacatttatttctggacaactcccataatggctttcatctttattctgttgtctctgagcttattttttgtggcaaccagaggtaaggagagtggttgaggtaatagaaaaccacacagttaaaccacacagttgtgaggcaacacaaatcaactcaagccaccaaaaaaggagtcctaggggactcgggttcaaggcttcttccatgttctttgaggagatattacttgagcagagacctgaatgataaagatgcatctaaccacaggccagaaaaagagcattccacttggcgggcacacatgcaaaatagcccaagttgagtaaaggagccactagacacgagtttggggaggatcaaacatgaataatatcttagagaatgaaacctgtgttgtcaagcaactgaaaaagaaccagggtggctgggacatggggacttgggaatgggtaggacccttgtggatcatgttgtatattttgggattttctccaagtgcagtgagataagttactgggggaggctaagccaagcatgcatataactgacactgtgcgtctcaggttggctgtctctgtaccccagagaccgtaagccaagcatgcatataactgagacggtgcatctcaggttggctgtctctgtaccccagagaccataagccaagcatgcatataactgagacggtgcatctcaggttggctgtctctgtaccccagagaccataagccaagcatgcatataactgagacagtgcatatcaggttggctgtctctgtaccccggaggccataagtcaagcatgcatataacagatggtgcgtctcaggttggctgtctctgtaccccagagaccgtaagccaagtgtgcatgtaactgagactgtgtctcaggttggctgtctctgtaccctagagactgtaagccaagcatgcatataactgagactgtgtgtctcaggttggctgtctctgtaccccagagaccgtaagccaagcatacgtataactgagatggtgcatctcaggttggctgtctctgtaccccagagaccgtaagccaagcatgcatataactgagactgtgcatctcaggttggctgtctctgtaccccagagactgggttgacagggatcaagaacagggttgggaggcagtgagcctctcaaggacagcaaatgtgggcttcccgactctgacaggattggcaagaggaatgagtccaggaactagaaaccaacagaatgtgacattttccctttcctgcaggctggtaaattgtcacctctcacccattgattgtgaagtccttgctggccttctaaccaacaacaagaagctgacgtatctgaatgtatcctgcaaccagttagacacaggcgtgccccttttgtgtgaagccctgtgcagcccagacacggtcctggtatacctgatgtgagtggatgttgggggtgcctactgtggagggccatggcggcagttcaaacctgggcctattgatgacagtctgctcattgatggaggccacatagcggaggtttaaaagctcacgcttaagaatcagaaaagacttgagttctagttcaggatttatcacgtatatactgtcttcttaagcaaaatatttaacttagaagcagaggaaaatcctgtcttagaggtcttatggctatcaagtgagactgtctatacagaacacgtactgtgtttcaaagctgttaggttgggttaatgcacctgcaacacacatggtacttcccgtgttgataacggttatttcgagcatgtagaatagacttggtgggtactcaggacagtagcggggaaaaatgtctatgggcctcttgaccccagttaatactataatacatgtgatgttcttgcagtaataggatgagaagaggctattcaagccagttttagggtacgtaaaacacagaaggaagacagatgagtaagtgttaaaggccaattgatttacctattaatggaattctaatacctttaggtgatacttatacaaaaggggagaggacaggagaatatatatgcatttgtgtctttttttttttttttgagttttgagttttgctcttgttgcccaggctagagtgcagtggcatgatcttggcttatcgcaacctctgcctcctgggttcaagcaattcccctgcctcagtctcccaagtagctgagattacaggcatgcgccaccatgcctggctaattttgtatttttagtagagatggggtttctccacgttggtcaggctggtctcgagtgtgtctattttttaaatacacaaatatcactggaagaaatagtattataatataggctgcctgtgagaaatagaactgagaagctgggagataggggaggatggagatttttccctctttatacttttgggcattttgaaatatgaacaacatgaaagtaagagtattctgaaaatgtcaagaaaatgagaggatttatacctcgagctaaaatagagggacagggacaggacttaacctcccacctaaaacaaccaaaaataaccaactaaataaaacaactgtttaagacttcagacatcaggcaatgaaggacagtggtgcctgagtgataagggacaaacaggtgagtcctagaattgtcccaggtaactatctggagagagatttcaggatgcagttcaggaaggggaacccagatggaagttggtagactctgtgagttggtgaaaccccgtctctactaaaaatacaaaatacaaaaattagctgggtttggtggtgcatacctgtagtcccagctactctcgagggaagctgaggctggagaatcgcttgaacctgggaggcagaggttgcagtgagccgagatcgcaccaccacacttcagcctgggtgaaagagcaagactgtctcaaaaaaaaacaaaaaataaaccaaaaaaaaaacaaaaaacaacaaagtccacaaatgcctggatatgccagaaaattgagatccgtgagagaagcaagctgggtgaggcctccgtggaaatgcagatcttgtgtctgtcaacaggaagcagttgcccgttctgtcctagcctgttggatttccatgtgggaatgcggctcattattgccagatatcccagttttcaacagaggttgaaatctagattttacatacaattttactgatggttatatattgccaactgattttgttaaacataaaaatgccaggaaatctaaatatccgtaggccatatgtggttcgttcatcactagcttgcaccgtctgcttttttgtttttctctactccacacttttttttcaaagtcaacatggatccttaaaaaaaaaaaattcataaactggctgggattggaggctcacacctatattcccaacactttgggacgtcaaggcaggtgaattgtttgagcccaggagttcaagaccagcctgggcaccatgatgaaaccctttcttgacaaaaaaatacaaaaattagcttggtgtggtggcacgcacctgtagtctcagctactcagaagactgaggtgctgaggtgggaggatcccttgagccagggaggtagaggctgcagtgagctgtgatcatgccactgcactccagcctaggtgacagagccataccctgtctccaaaaaaaaaaaagttttgaacctactgtgattttaaagaataatgaaattgaaaaagttggggattctacacatgaggtaatcaatacactttaccagtccctgagggagcggtctcagaaggtccatgtcttgtccaaggacatcatcagatgaagaattagaaccaaaattaaagccctgttagagtattagctatgccatattacacgatactttttccttctgcattaccctcttattttctaattcttctatcatgcaactaagaagaaatgagagggccggacgcggtggctcacgccttgtaatcccagcactttgggaggccgaggtgggcagatcacctgaggtccggagttcgagactagcctggctaacatggtgaaaccccgtctctactaaaaatgcaaaaattagcgagatgtggttgtgggtgcctgtaatctcagctacttgggaggctaaggcaagagaatcacttgaacctgggaggtggaggttgcagtgagccaagatcgcgccgttgcattccagcccgggcgacgacagcaaaactccatctcaaaagaataaatgagaggaggtgttttcagataatccagaacttcatctcagctggggagtttgtaagattatagaaatattaccctgaatgtgaaattaagcaaatctccctgagacaccacgtccctcttcactctccttctcgtgtttttgtccccataggttggctttctgccacctcagcgagcagtgctgcgaatacatctctgaaatgcttctgcgtaacaagagcgtgcgctatctagacctcagtgccaatgtcctgaaggacgaaggactgaaaactctctgcgaggccttgaaacatccggactgctgcctggattcactgtggtaggctttttgctgtttctttgaagaccaagccgtcttttcaagggcatgcactgctgagaatggggcatctggaattgaggaaggctgtagtgtctgtgcctgggcatgtgaaggtttaaaaaatacttgcttcagattcttgtcgagacgttcatgtaaacaaatcagcaccctgacttctgtggcatggatttaatatgttgcaaagagttctccagtggcatataggtagaggactgagagagccggaattaggtcgggacctgaggggcaatttcatggcgaagatgatatttggtgtgtgttctacaaaatgaatgcacttcatcaggtgcaaaaataaagccaaaattccaggtagaagggtaaaacgtgaaggtgggagatccaaaaatacacgtgagaattaatgtgtgtaacagagaatgctttagaagaagacaaagggtagcatgagatgagccagaaaggagatggtgaaaagacttaatttcatgttatcaaatagagaaatatctgggtaacccctgtagcggcggtggcagtgtttttagaattaccagttaggataacatgttgttatgtattttccctgaaaaatacagaggcttctgaaatctggcagcgtgatttttacctaatccattaggaaatcagtttaggattttgtattcctcacttgaagagtatgttaaataacataacaaaaacaccagatgcattctttctctcccagtagtgcgttaggctatctgggccaatcgttggcactgaaagacaccaaaaacatcagatacaatattaagaaaaaatttaaaagcatctagaagctaaacagaaataatcttttttttttttttttggagacagaagagtctcgctctgtcagcccacgctgaagtacagtggcacaatctcggctcactgcaagtgctgcctcccgggttcacgccattctcgtctcagcctcccaagtagctgggactacaggtgcccgccaccacgcctggctaatttttttgtatttttagtagagacggggtttcactgtgctagccaggatggtctcaatctcctgatctcgtgatccgcccgcctcggcctcccaaagtgctgggattacaggcatgagccaccgtgcccagcccaaacagaaatattcttaagtagcaggctaagtagatagcacttaaggctatccaaaactccttaagacgtattaaaaaaacacaacataaccttaaactagtactgaacagatgcctgaaagaaacaagagcaaattgtctcaggaggtaggtaataggatgacatgatccttgacctcagcttattcctaaaaggattttttaaggtcagtaaataccacacagttaaaataacccaacccacaaggaaataaagctcattgagccaaggacaagtcaaaatacaaacagctaccaaactatctaattatctataaagctattatacttactatgtttacagaaaaataacaagtttgaatcttagggaaaaggagatgaaatgagcaaataatacaactagaaattataaatataataactgactatatggggtgaatagtagattagacataattaaagaaaaaattagtaaaatggaagataggttacaattacctagaaagcagcatgaaaacagaaaaataggtaaatcatagaagagggtataagacttagatgattaagatgttctaacacacttactgggaatcgcggaaagagaaaatattttaagaagactgaaatttttctgtaaccaatgaaagattccaattcagattcaagcatccaaataagcgcttaacaggataaatagtggagaaactgcagaacaccagatataaagatgttggtctgtaaagatttaacaaggggctgggagcttggggcgggggaaagtgatatctacaagaaaggagacagacttgggtgaagagtaatagtggaaaccagagggcagtacagtgagatattcagtatggcggggagacgggagggtggattgtcaacctagaattctatagccaccaaaaactatcaagaatgaggataaaaacacattttcaaataaataccaagtttcttaccaccagatccttcctaaaagtaattctaaagactgttccttagacagaagtaaatcattccagatggaagagagatagagcaaagagaggggtagatctctggataaatctaaacaaaatgtggattgtgtataaaaataataccatcttgaagatttaatggaaaaaatatacaacagccataacaaaatataaaggggtaaattaaggtgaatactcaaattagcagaaaagaggagacagaatgattaaaaaattcccgatccaaaaaagaacaaggaaacaaaaattgaacaggtaagaaaatatgaaacaagatatatatttgaattcaaatatgctagtaattaaacgaacagattaaatgtttcagctaaaagattgccatattaaaacgtaactaatgtttataagttacttattaaaacgtgaggttgtggttgtacaacattgtgaactgtagtaagtgccactgaactgttcactttaatatagttaatcttaagtaaattttacctcaataaaatgatgaaaatgaaaggatagaaaaaaagaccacgcaaatattaaaaggaagcttacgcaactgtatgaatcagacaaaatagaatttaagacaaagtattattcggttcatgctaatttttaaattatcttcctactcagttgaactttaaatcttacaaggtgaacataattacttcccatatagagtccaggaatctaagagaaatcataatggaaattagaacatatgttgaaatgaaaaaggaatatactttgcaacaaactcagatggagctgtagtgcatgtatatattttaaaaggaatctaaagaataatgaacttaaggatttttttaatggtaaaataaaccccctaaaggatggaaggaaataaaaataaggacagaaactaatgaaacaaaaatcacaatggaaaagatcagaaacctgcagggtggttcttggaaaaaacagtttttgttaatgccatcctatagaatataatgcaagccacacatgtaatattaaattttcaagtagccatattaaaagtgatgtaatatttgaaagtaattttataagtaaatatttgaaactaattttaataatatagtttatttagccatatatcaaacatcacttcaatatgtaatcagtacaaaaaattactaatgagagattttacttttttgtattaactctctaaggttcactatgtattttatactatggcacatctagattcagacaagctacattccaagtgctcagtggtcacacgtggctggctatcacactgaagagtgcaggtctatgtcaagaatgggaaaagaaacattactacagatgctacagatattaaaaagattacatatgagcaactttacacaataaacttgaaaatttagatattttcaagactcaataagcttctaaaatgatagaacctaaatgtactcaagacaaaagaaaaatgaatcagtcaaatctttttatatagaaaattccaggcttagaagccttcattggtgattcttaccagacattcaaagaataaataattccactcttacatcagctttttcaggatcagaagaggagaaactccccaccattttttgtggctagcataatcttgatgccagaaaccaataagaattttattggttgtaatataatccttacaatttttgtaagaaagcagaattaaaggctagtgtcattcatgaaatgcaaaaacactgaacagaatattagcaagcagaatccataaatgtattaaaagaataaacataatgactaagttgggcttatccccaaaatgtaaagttgctttaacattaaaaagattagtaaaaaaatcaatgtaaatcactttactggttaaaaataaaaatcatgatctaaaatgcagaaaagtttgaattaagacatacaattcttgaaaaactatttgggaacttccttgatgatctaaagaatatgttcaaaaaaatctaaagcaaacatttgtctaatgatgagagaaaagctttctcttcaatatcatgaaaaagataagaacggtggctataatcacttctagtcaacagtgtcctgaaaatcttagcaaatgcttcaaggtaagaaaaacactaaacctgtaatctttgaagaaacacctaattctatacagatgatttgaatgtacatagaaaaatccaagaaaatctgtagctaagttatcagaattagtctaacaagcttgcttgaaacaatatatcaaaaacagttactgatataccaacaagaagtaataagctagtggaattaaataaaagtaccttttacagtaacataaaaaagaaattacctagaaatagctactgtgatatatgtgagacttttatagagaatatgatcaaattatggtataaaacaatgttatattcaaagattgaaatattcagtatctaaaaagtcagttttctgtaagttgaattcatttgctttcatgaaatcccagtgaaaatgcgatgtttttgtttggtgattgagttgaacttgaaaagtaaattttaaaatgtgtatggaacttgcaagaggccaagaatacctaagaaacacctaaaatataaaaagtgggccaggcgcggtggctcacgcctgtaatctcagcactttgggaggctcaggtgggtggatcacctgaggtcaggagttcaagaccagcttgaccaacatagtgaaaccccgtctctactgaaaaaaaaaaaaatacagaattagctgggtatgatggtggatgcctgtaataccagctactcaggaggctgaggcaggagaatcacctgaacccgtgaggcagaggttgcagtgagctgagattgtgccgttgcattccagcctggacaacaggagtgaaactccgtctcaaataaaaataatgtaggaactcttgctctaaatgtgtcatctaaagttttagaaattaaaaaagcatgagattcacacagggataagcagacagaccagagacacagaatagagatctcagaaacagactgatccacgtgtgttcagatgtcgcatcatggaatagcgtatcactggtgcagagagaggatagacctccaacaaacgatgctgagacaattcagttgtccctccatatccataggaggttggctacagatttcccctgaggagtccaaaatctgtagatgctcaagttcctaatgtaaaatggcatagtgtgtgttttgagacagtctctcactttgtcgcccaggctggagtgcagtggtgcgatctcagctcactgcaatctctgcttcccgagttcaagtgattcttgtgcctcaacctcctgggtagctgggactacaggcacgcatcgccatgcccggctaattttttgtattttttgtgttttttttagtagagatgagggtttcaccattttggccaggctggtctggaacttctgacctcaggtgatccacccacctcagcctcccgaactgctgggattacacgcatgagccaccgcatctggcctatatagtgtttgcatataatgtacaggcatcttcccataatactgtaaatcatctctaagttactgtgatatgtaatacaatgtaaatgttgtgtgaacagttgttatactctattggttttttcgtttgtattttttagtgttgcgtgttatgtgttattgttttaattcttcaataatttcaatctgccactagttgaatctgtggatatggaggactgacggtgcctatccacatgaatgacaaaggctgtcgtgctttggtgtctcttttcctgatattagactgaggtgtaatagcctttaagcatggtacccttactcctttgcagtttggtaaaatgttttatcactgctgctggctgtgaagacctcgcctctgctctcatcagcaatcaaaacctgaagattctgcaaattgggtgcaatgaaatcggagatgtgggtgtgcagctgttgtgtcgggctctgacgcatacggattgccgcttagagattcttgggtgggtatcgccaagctcctggttatgttttcatgagtggcaaagacggaaaatggatgggaagaaagagaaagatgaaaactccaacaggaccacatagcagctagctgtggttgcatcatgaaccagtgtaaaacttcagggcttaaggcaatgagaagttagattgctgctggctctgcttgtctgggcaggcgtcactgacctcagccaggtgtgcttaggaagctgtggttaactgagggattggctggtttgggttgaccttgctatatggtatggaggttggctggctgggttggctgtccccttggggatgacaggtgtaactgggccacgtctcattatctaactggttggcctgggctcattgacatggcatctgtatcagtttgccagggtttaaaaagtagcatggactgggtggcttaggtaatgaatttatcacttcacggttatggaggctgaaagtctgagatcaaagtgtcagcagagttggctccttctgaaggccatgagggagaatctgcttcaggcccttcttgtcttgtcgataaccatctgtcttctccctgtgtcttcatgttctcttccctctgtgtgtgtgtgtctaaatttcctcttataagaacaccagtcatatgattagaatccccccagtgtcctcattttagcttaattgcctctataaagaccttgtatccaaatatgatcacattttggggtactggggtttaggacttcaacgtataaattttggcagggacagaaatgagcccatagcagcatctcaggagttcaagagatgaagtatagaaaacatccaagatcaccaggtgtgatagcttagtcctgcagtcccagcactaaaggagcctgaggcaagccaatagcttgaggctaggagttcaagaacaggctgggcaacatggtaaaaccccatctccataaaaattagccaggcgtggtgcatgcctgtagccccagttactcaggaggctgaggaaggaaaattgctagaacccaggaggtcaaggctgcaatgagccatgatcatgccactgcacttcagccgggatgacagaaaccccatctccacaaaaattagcccgcaggcgtggtgcatgcctgtagtcccagctactcaggaggctgaggcaggaaaattgctagaacccagcaggtcaaggctgcagtgagccatggtcatgctgctgcacttcagccaggatgacagagaccccatctccaaagaagaaaaacacccaaaatggtggctcagaactctcctaatcttgcttccattgttatctgagacggcttcatacctttttttggataatatgttatattatccaaagcaaggtatgaagccggaaatagactctgttagtggaatgagctgcaaagtcacattgctgtgggcagggatacagagaagaatggacacttatggctacttttaccacctacccacagacgcgtgatctgaggtcgtaaacactggactgtgagagattgcacttgaggcaatggggtgtgcctcaactagacgtctagctcacatcccatcctacctccaccctgaggctggggccgcatcttaccatgtgtctttttattgcaggttggaagaatgtgggttaacgagcacctgctgtaaggatctcgcgtctgttctcacctgcagtaagaccctgcagcagctcaacctgaccttgaacaccttggaccacacaggggtggttgtactctgtgaggccctgagacacccagagtgtgccctgcaggtgctcgggtgagctggggtctgttgtgctctatgggcagagtgctccgggctaagaagggattggctgggacctgcagtgtaatcacgttgcatttaaaatgcaaatgatgttccttgtctcagggttgttgcaggagtaagaaccaagcaggtgagtataaaactcttaccacagtaagtggtgaacagtgaatgtccaacaaatggaaacacttgtgaagtggcctcattgtctggggtaacacccgaggttcattgtcccagggccgtggagatccaaggacgcagagatccaaggacgcagatacacaaagagtgaggttaagagcagaagtttaataggcaaaagaaagaagagctgtctgctacagagaggggtctcggaaaaatggattgcccgatccatggtgaaatgcagagggttttatagacgagctggtgggaggtgtggtgtctgatctacatagggcatgaaaaactggttaggaccaggtgtgccgtttgcatagggtgtgaatttctggcagcccccaccccagtcttttattaagcaggcaggttctctgcctgagctgcactatgttgcccatttctttcttactgtacccatgctaataaaaaagggaagatggtgcttccatggtgaacaggcctggcccccaggtagctcttttcactggcgcagctgctggcattccccccatgcaatcttcgcgctcccttatttatgtttgcagctcagtttttcaggatgctctttgttagaaaagaaatgatttcttgggctggtttttgttagaagggaagctctgctgaggacttttgccctcactatctgcctaaataattttttacctcctatatcacttattattataatacaaattatgatacatgtttatattttaaatatttatgtgtaaatacaagttatatgtatattcataagtataacatttataaatagaaacttatataaacataatttatattttaatttgttatatttataattacatataatcccacaaacattattttactagataactatagagtccttaacatttttctcattcattttcccctactgttttcaaaccaatatgagatgaaggtaatcataggcagttattaggctgttcatttccagaaaagggaaatataatgggttaaaactgttataactctaacgctaaagaacattcactgatttttttttttccattttgtgaagatacaggtttgttttcttgaagtccatccttataaatctccacctggaaaggctgagtgcttggcattgtttctttctcattttaatgtttgctaaagattcagaatgtagactaccaaagtagacacgtgattaaggggaaggactcaaattgtctgcattctgagtcacggaggtctgtgtttgtctcctagccttgccatgtttggccctgtaagccagggtaaggcatttgtcctctttgattatcagcctcctatctacaaaatagggatgattatttggcatggtaattatgaaagtatgcatcagataatgtgataactatggcagaactaaataagtgagttttcatcttcctccagcccctaccatagatagtctcacaaagatgtgtattaagatacatagttgtgctaaagaacatagcttaccccaacagtgtgggacagttgcacgcaaacagatgccaaatggagatgagagatattatacgtaaaaggaaggaccaagacacggtgatacttaatccttctgattcaaagcaatgatacaacgtatgggggctccagaaacaaattgcttgaatttgtatccagactaccactttctggttttgtgaccttaacattgttctcattgtcttcatcacaagtcgggacaattatgctacctcataaggcagttgtgaacatttaatgagataggcatgtaaaaagccttagcagagggccagggcccaggtactcggataatggaaactattaactttatctttgaaaaagtaaaaatagcttcagtctttctccctaactcccactgacttcttgttgcaaatccaaatgtttgtgtggagttcatgccttctattaccaattctggacatttatttatgtccagtgacatattggagccagctcctacaagctggtgagagccacgtgtgtgtgtgtgtgtgtgtgtgtgtgtgtacctgtctttgtaactctgtttagtgacagcaagtgggcagctcaaaattggccatgattgccttggagaatttacaccacagaaattggcaaagctataaattgggactttatttattttctggggatccaggggtaacatttatcagcataccgctgcatttgatgtgtatgtctttcctcttggaggtaacaccagggtttcctaggcttgtcctgggatgaattagggagaaagatgagctgcagaaaagggaaaaagtatgtgaattaaaaatagaacctcttaaaatattttaccaggctgagaaaaactgattttgatgaggaaacccaggcacttctgacggctgaggaagagagaaatcctaacctgaccatcacagacgactgtgacacaatcacaagggtagagatctgattgcgaggaacctgggctctgactcgaacacctgcaaaggacagggactgggaccgttacttacatgacactgcacccaggagatacaaatcattgatactctgagttgtgagatttctggcaccccattcatagatttgatatgatacacgtggtttttatgtgctctgtggccttggatgagtcactgaaaggccttcatggtctctcggtctcacaaggacctcttaacccctcaataaagtgttacatttctaaacattggaa

SEQ ID NO: 422 - DNA, 23998 bp, Homo sapiens
ctgcaacgagagtgctctaactttattatccctgtgagaaagtacatagcgtcatgtgaagggggtgcgtgactcgtgcagaatctcccaaaaatagtgagaaaaccagtgtcaaatcctacctctcgacagactctagtgttaacatgtgaccctctgacctgcattcataagacatcttagagacccgaatcccgcttcctgtgtaattcgtagagcgatcccaggctgctcagcaaaaaaagtcacagcacggaggtgccgttgccccggaagcattgcaatcaatagtcagcttgggattcttttctttcacttcctccaacagcttcttgatttccaaattagtttcataggtcttcaacctggagggatcagagaacacaaatgttcccagaaattcattctcaactacccaggatgcctgaatatctgttttcaaacactcaaagcaggaaacgtttttgggattttctgggggacagggtcttgctctgttgcccaggctggggtacagtggtgccatcttggctctctgcaacctccagctcccaagttcaagcaattctcatgcctcaggctcctgagtaactgtgattacaggtgtgcaccaccacgcttggctaagttttgtatttacagtagagatggggtttcgacatgttagccaggctggtctcgaacttctggcctcaagtgatccatccacctcggcctcccaaagccatgggattacagatgtgagccacagcacccagtcagaaaagttttctaaaaagaaatttagacccacacaatggggatccttataagtctaagaaaaaaaagattatggccaggcacggtgtctcgcacctgtagtcccagcactttgggaggccaaggcaggcagattgcttgagctccgcagttcaaggccagcctgggcaacacggtgaaaccctgtctctaccaaaaatagaaaaagttagccaggaatggtggtgcacgcctatagtcccagctactcgggaggcggaggcaagaggatcacttgagcccaggaggcggaggttgcaacgagctagagattgccctactgcactccagcctggtaacagagtaaaacatgcctttaaaaaataaatttaaaaaatagataatcaggctggtgcacggtgactcacgcctataattccagcactttgggaggccgaggcgggcagatcacctgaggtcaggaattcgagaccagcctggccaacatagtgaaaccccgtctctactaaaaatacaaaaattagctgggcatggtggcagacaactgtaataccagctactcaggaggctgagacaggagaatcgctttgaacctgggaggcagatgttgcagtgagccaataccgcaccactgtactgcagcccgggtgacagagcgagactctgcctccaaataaataaataaaaaatagtggcaaatcaaaccttcagtagaactaagagaatgccagagtgaaccccagggttaatgatagcaaacttggctctaacgtggctgcagcatgcaagcctgtgtatgtgaacatgaggggtggtgattgtggagacactggcttgctatgttgcccaggctggtctcaaactcctggcctcaaacaatcctcccaccttggcctcccaaaggaggaactgaggaatgagaaaagaaatacgccccaaacatatgacataagagaccacagggggctagagatttgtcaccaatagtccttggtggcattacagacctcggtcccaccaacaagagaagcatgacactatttagctcaagtttcatgatatacccctaaaaccttaacccatttatgccagaggttacaattatttgaactgcagacgtgtgaaaaatcgtaccttgagcaggatataaataactcccacatgcttagcgttccaataatgcaacactgggcatcatgaagcagtttacatgcgtatcatctctacaactaaaataactcttgaataagacaagtgggctgtgcacagtggctcacgcctgcaatccgggtactttgtgaggccaagacaggaggatcgtttgaagccaggagtttgagaacctcggcaacacggccacacagtgcagcagagcaaaacgttgtctcagaaaagaaaagacaaaggcaagaagaaactaaaggtagattacgttaaaataagtcactgaggccgggcgcggtggctcacgcctgtaatcccagcactttgggaggccgaggtgggcagatcacctgaggtcaggaattcgagaccagcctggccaacatagtgaaaccccatctctactaaaaatacaaaaaattagccgggcgtggtggcgggcgcctgtagtcccagctgctcgggaggctgaggcaggagaatggcgtgaacccgggaggtggagcttgcagtgagccgagatcgcaccgcttcactccagcctgggcgacagagactggagtctctgtctcaaaaaaaagacagattcaaaaaaaaagacagactccgtctcaaaaaaaagactccgtctcaaaaaaaaataaaaaatacaaataagtcattgaaaagatatacacgggtcacaactaagggagcatctgtaggacgatcttctgaaaagctaagacccaggacagctctgggaactacctatttttggatataatgattaggggtgtgtgtgtgtgtgtgtgtgtgctcatgcacacacatacacacaagcttccagtctgtactccaggatgatttaaactctcagtatgcctaggactaagtgttttgggggaaagttggacaatattcaattcacagagcattttagaaaagtatctaatttttaaattatctcctaagctaggagtgtgctatagaaagatgccttaagttgatccctacaaagagtacacacactcccaaaaaaactcttctctgcatgggaaattcaccatgtgaaacagccatcccagggccgagcacagtggctcacgcctgtaatcccggcactttgagaggctgaggcaggtggatcacctgaggttgggagtttgagaccaacctgaccaacatggtgaaaccccatctctactaaaaactacaaaaattggccaggtgcagtggctcatgcctgtaatcccagcactttgggaggccaaggcgagaagatcacctgaggtcaggagctcgagaccagcctggccaacatggcaaaaccccatctctactaaaaatacaaaaattagctgggtgtggtggcgagcgactgtaatcctagctactcaggaggctgaggcaggagaatcacttgaacccaggaggcagaggttgcactgagccgagatagcgccactgcactccagcctgggggacagagagagactctgtctttaaaaaaaaaaaaaaaaaaaaaaaattagccagctgtggtggtgtgtacctgtaatcccagctactcaggaggttgaggcaggaaaatcgcttcaacctgtgagaaggaggctgcagtgagtcaagatcgcgccactgcactccagcctgggcaacagtgagactccatcccaaaaagcaaaaaccaaaaaggccgggtgcaatggctcacctctgtaatcccaccactttgggaggccgaggcaggtggctcacctgaggtcaggagttcaagactagcctggccaacatggtgaaacccctctctactaaaaaattagccaggcatggtggcaggcatctgtaattccagctacttgggaggccaaggtgggagaatcgcttgaacccaggaggtgggggttgcagtgagccaagatcgcaccactgcactccagcctgggctacaagaacaaaactccgtctcaaaaaaaaaaaaagaaaaagaaaaaaattagctggacatgttggcatgcctctaggcccagctactcatgaggctgaggcaggagaattgcttgaacctgagaggcagaggttgcggtgagccaagattgcgccactgcactccagcctgaatgacagagcacgactccatctcaaaaaaacaaaaacaaaaaacaaaacaaaacaaaacaaaaaacccatacctgagtatcttcaaggatccagttctttgtcttagaaccccaaagagcttaattatgccactcttccacaaatgattctggcccaggtccagagtttcaagcttctgattgctgaggagagcagatccaagatgctgacaatagaaaggcatgagggagcagctccagaggctgttgaggaagaacatggaaatccacgcattcactgagcaggtagtggctcaagcgtgtaatcccaacacttcgggaggccaaggcgggtggatcacttgaggccaggtgttcgagaccagccttgccaacacggtcaaaccccatctctactaaaaatacaaagattaggcagggcgtggggacagacacctgtagccccagcaccttgggaggccgaggagggtagatcacctgaggtcaggagttcgagaccagccaggccaacatggcaaaaccccatctctacaaaaaattagccatgcatggtggtgtgtgcctttaatgctagctacttgggaggctgaggcacaagaatcgcttcagcctgggaggcggaggttacagtgagcccagattgcgccactgcactccagcctgggcaatagaatgagactccatctcacaaatatataacataaaatgaaaatacaaaaattagccaggtatggtggaaccacctataattccagctactcgagaggcaggagaatcgcctgaaccaggaggcagaggttgtagttagccaacatatcaccactgcattccagcttgggtgaaagagtgagacttggtctcaaacaaaacaaaacaaaaaaacaagcagcatatttgctggggctccagtagtgaggaaaggcagaggggagtgagcagaagaaatccttgtcctcagagtttttagtgacagcagacatctcgatatgttctattgaagacaatggatgatggtattaaaataaacagggtagaggtaagtcaaacagagaggcattgattggctagacttatgctggtcatttaagtcctcttttggaaagtgatatgaggaaagaaactgaaggatggtagatcatgaaccagcatgctaactgggggagggaatcttgtaaataaaatactgagctagtgagaaagtagaatgatttatggctcataacttacacgaggatcccccataaggccctgtaggccactgtagaagcctttggttttgttttttttaaggcagagtttcactcttgttgccaaggctggagtgcaatggcgtgatctcggctcactgcaacctccgcctcctgggttcaagcgattctcctgccccagcctcccgagaatctaggattacagtcatagctgagattacaggaacaagacaccaggtaatccacccgtttgcattgagcttttgagtctttggaaataaaggtatcacggtctggcttgaggcttgaaatattcctcagggggatgggttaagaaacttcaggaggccaggaatggtggctcatgcctgtaatcccagcactttgggaggttgaggcaggtggatcacttgaggtcaggagtttgagaccagtctggctaacatggtgaaacctggtctctactaaaaatacaaaaattagctgggtatggtggtgcacgcctgtaatcccaactactcagctcaatcaggagaatcgcttgaaccttggaggctgaggttgcagtgagccaagatcgcaccactgcactccagcctgggtgacaaagcgagactctgtctgaaaaaagaaaaaaagtaccctgtgttctagtgttttttttctttactctacagcaaagctaagtagtaatgacgtgcagattctctttgcattaggattgcagattctagttggaaaataggttgcatccaagagatgcaactgacaaactttggggagagaagtgatgaagagctcgccattccatttgtggagactttgcattttctgggggtggtatcccacctatggttccctgggtttatgaggtggggcaggctcactgcttcctgattactggatcccagcagaagcagcatgctgctgaagtccaggtcactgggggccattgttatatatatttcacttctccaggccctctacctgactttagaagtgcccacccacatatattcagtttctggaggggtttgatcttaaaactggatccgaagtgatacagtctgagatattgaaaacatagaaattggccgggcgtggtggctcacgcctgtaatcccagcactttggaaggccaaggcgggcagatcatgaggtcaggagatcgagaccatcctggctaacactgtgaaacccatctctactaaaaatacaaaaaaaattagccaggcacggtggcgggcatctgtagtcccagctactcaggaggctgaggcaggagaatagcgagaacccgggaggaagaggttgcagtaagccgagatcgcgccactgcactccagcctgggcaactagaacgaggctccgtctcaaaaaaaaaaaaaaaaaaagaaaacatagaaattaaggatttccagatttccaaacactttaaaaatgaggccaggcatgatggctcatgcctgtaatcctagcacattgggaggccgaggtgggaggattccttgagcaccagaattcaaaaccagcccgggaaagatgacaagacctcatctctacagaaaacagttacctggccatggtaatacatgcctgtagagccagctactcaggaggctgaggtgggagaaccgatcaagcctggaagaccgaagccgcagtgagccgtaatcaccccactgcactccaggctgggggacagagcaagaccctgtctcaaaaaaagaaagaaagaagaaaaagaaaatcgcctaccgtaggtgttttaggttacagtttggattctctaatgcctgacagagaatccacaatccacgagctatctggttgatactcaagtccaggtttgtgaggctgcaggcttcttggagcgcctctgagagatatctacagccaagcttggttatgctgcattgctgtaacctacaggataatcaaaggaagagaagcctgttatccctctggctaacgccctgtgaagcagttatttccaacactatataccttccacttatatactggaatgcagtgctgcactcttggctcactgcaacctctgcctcccaggttcaagcgattcttctgcctcagcctcccaagtagctgggattataggtgcccgccacctatataaccagacttggtggtgcacgcctgtagtgccagctactcagaagactgaggcaggagaatcgcttgaatccgggaggcagaggctgcagtgagctgagatcgcgccactgcactccagcccgggcgacagagcgagactccgtctcaagaaaacaacaacaacaacaaaaagtatttatataaaacataggtggcaggtaggaattgacccatgaactggagctatatacttccaggtgggcttgcacataaaagcatgcaaatgggccgggcacagtggctcacgcctataatcacagcagtgggaggccaagacgggcagatcatttgaggtcaggagttcaagaccagcctggccaacatggtgaaaccccatctctactaaaaaatacaaaaatcgggccgggcgcggtggctcaaacctgtaatctcagcactttgggagaccaaggtgggtgaatcacaagatcaggagttcaagaccagcctggccaaagtggtgaaaccccatctttactaaatacaaaaattagctgggcacgatggctcacacctgtaatctcagcactttgggaggctgaggcagacagatcacctgaggtcgggagttcaagaccagcctaagcaatatggagaaacccgtctctactaaaaatacaaaattagccaggtgtggtggcacatgcctgtaatcccagctactcaggaggctgaggcaggagaatctcttgaactggggagacggaggttgtggtgagcagagattgcaccattgcactccagcctgggcaagagcgaaactccatctcaaaaaaaaaaaaaaattagccaggtgtggcggcccatgcctgtaatcctagctactcaggaggctgaggtaggagaattacttgaacccaggaagcggaggttgcagtgagccaagatcgcaccactgcactccagcctggtgacagagagagactgttaaaaaaaaaaaaaaaacatccaaatggccttctgattccatccatttccagctctgcctgggacaacagcttaggctctgggttcagaccgacccaggacaggatctgagccctgggtcacttattttctgcgtggttagattatggaaatttcactttccctgtcattttatttcatgtttaagttttgtctttaactgacacattctacatatataggggtatagtgtgatgttttggtgcaggtacacttcgtataacgatcaggtaggtgactgtttgtttaacaatagttattctaagccaggcacagtggctcatgcctggaacgccagcactttgggaggccgaggcaggcagatcacttaaggccaggagttcaagaccagcctggccaacatggtgaaacctcatctccactaaaagtgcaaaaattagccaggcatggtggagggcacctgtaatcccagctacttgggaggctgaggcaggagaatcgcttgaacctgggaggcagaagttgcagtcagccaagattacaccactgcattccagtctgggcgacagagtgagacttcatccaaaaaaaaaaaaatgaatctcagaaatgaccactagctagaatttctgaacaggaacaggtcttcaaccctatgcaatctcttgaatatttttctaaccataattttaatgtgaacaggtagctcacgctgggcttctttccatataacaagattcagccaactatagttcgtgggtcaattccaacctgccacctatgtcttttacaaataaggatttttgttgagtttttttttgtttttttcttgagacggagtctcactctgtcgcccgggctggagtgcagtggcgccatctcagctcactgcagcctctgcctcccagattcaagcgattctcctacctcagccttctgagtagctggtactataggcacgcaccaccaagcctggttaatttttgtattttttagtagcgatgggttttcaccatgttggccaggctggtctcgaaccttaggtgatctgcccaccattcaccacctgttccccaataacctatggaaataaaagtttaaaaaaaggtgccactggccctaccacataactcaatctacctccaatagcaggcagtactatgtcataggaatttgaaagaacacacacaaagcatcagatccgagaaccaactactcatctcaaatcttccttcatagcaggaagaggctctgctgacatgcaaatattaacatgtttctacctgtatctgcctggttttttttgtttctttgtttttttgagaaggagtcttgttctgtcgcccaggctggagtgcagtggtgcgatctcggctcactgcaacctccgccttccaggttcacgccattctcctgtctcatcctcccaagtagctgggactacaggcatccgccaccacacctggctaatttttggtatttttagtacagacagggtttcaccatgttaaccaggatggtctccatctcctgacctcatgatccacccgcctcggcctcccaaagtgctgggattacaggcatgagccaccacgcctggcctctgcctgttctttaattcttaccaggtttttaaaagttacatttgaaatgaattaacaagtactttcatgtctctcctgcttgaattcatgtgcacacacacacacacccagcagggacttacaccaaggtctgcagtttacaatcagggtaactcaagccctcacacagaaacttcacccctgtatccccaatggggttcttggccaagcacaggtgtgtcagcttcttgctgacaaccaagacagcagcaaggtccttgcaactggcttctgtaagacgacagttttccaacctgcaaaaatatgaaacaaatggtagaaggatgagaacatttccacaactccaacctgctcagtgatgtccacatgctagggtactcagcttcagcccttcctgttcatcccctgccctctgtcctgtgggagtcatcatggccacaaaagagcaggaaggcgagaaggccaagatgcagcggtccacctggagccatcacaggacacaggtgttgtttttgagacggagtctcgctctgtcgcccaggctggagtgcagtggcgcgatctcggttcactgccaatcgccgcctcccaggtttacaccattctgctgactcagcctcctgagtagctgggactacaggcgcccaccacacctggataattttttgtattttttagtagagacggggtttcaccatgttagccaggatggtctcgatctcttgacctcgtgatctccccgccttggcctcccaacgtgctgggattacaggcatgagccaccgcacccggcctgtttttggtatttttaatagaaacagggtttcaccatgttggccaggttggtctcgaactcctgaactcagatgatccgcccacctctctgctgagattacaggcaggagccaccgtgccgggcctgaagcaggtgtttatttcagcaagaggcgccacgtgggtggcgcagtaagtcaggtgttaccctttctcttctatagccccagaactaaaccagagctgcccatgggaagaggagacttacgacaacatctgcaggaagtgttttgggcgtgtcatggtcttgtacagcaacatggcaccctcatccaggagcacattggctgagagacgcaggtgcttcagggactggttggctttgaggacatagaagaattcagcccactgctccggggtggcacagtgacctcccaacctgtgaaaagagtgggaaaagtcattcttctgggaggacagagtataccctatcagctttttttttttgagacagagtttcactctgttgcccagtctggaatgcaaaggcgtgatctcacctcactgcagcctccgcctcccgggttcaagctattctcctgcctcagcctccgaagtagctgggattacaggcattcgccaatttttgtatttttagtagagacgggatttcaccatgttggccacactggtcttgaactcctgacctcaggtgatccacccaccttggcctaccgaagtactgggattacaggtgtgagccaccgcgcctggcccagatcagcttcttctgcttcacttcccaagacattatgtctttggtttatctcattctactcatgcctccaaccctggcctgaattactggagagatctaatgttgcctctgcttcttcaagtatccccatggccattagggtaacatccagccacttctccaagagattgtaatacaattctgtgcaatgtttcaccaaaacggcctgtgtggatgattttgcaggggggaaaaaaaaattttttttttgagacaggatctcgctctgttgcccaggctggagtgcagtggcatgatcacaggtcaccacaacctgtctcctgggctcaaatgatcctcccacctcagcatccactgtagctgggactagaaggggcaaattgatgcttaatactcaaaataaaaattttatcctggccaggcgcagtggttcatgcctgtaatcctagcactttgggaggccgagacaggcggatcacttgaggtcaggagttcgagaccagcctggccaacatggtgaaaccctgtctctattaaaaatacaaacatttgccaggcgtggtggtgcacgcctgtaaccccagctactcgggaagctgaggcagaactgcttgaacccaggaggcggaggttgcagtgaacgagatcgcgccactgcgctccagcctgggtgacaagaataaaactgtctcaaagaaaaaaaaaaaaaaaaaagattctcattgagtgcagagaaggttgcatgctccttatgaatacctaactcctgatgatctgagattgatgatccattctcctcaggctcccaaagtgcgaggatcatgcactccataggatcaggcaccaacgattagctcctgtgcctgatctgagatcgaacagtttcatcccaaaactacccccaaacccgtctgtggaaaaaactgtcttgtgcaaaaccggcccgcggtgcagaaaaggctgggggccactgctctcaatcccaacaattaggcaaggtgcagtcaggaatagcatgtccctaaagctggaacccagcacagaattcggggtgtttctttgcatggatagctggttatgcaacacagaagacaagctggtgggggaaagaggagaggccgactcccccacacaggcctgtttgaggaatacattccctgtctgggacggcatctggagtggttaccctttttcctagatcccccagcaacacggtgcagtggactccaggtgctggggagagccgtgaccgtgagacccacctcaggtactgcaggttgcatttatgatttctgagcaggtcacacagcatcagcatcatcgtgcgttcccactcgatgtgccctgccagggtcaggtgcgtgagggtcttcttcccaatgaaagcaagacagaagtcccggtacgcggtgtcaggggtgacgtttttaatcctagggaaaagcagaagagattccacttggagtgattaatactcacattgtgtggaggcatgtataaacaaaaagctgtttcacatttagaaattattagaagttcttggccgggtgcagtggctcgtgtctgtaaccccagcactttgggaggctgaggcaggaggataacctgaggtcaggagtctgagaccaacctgggcaacatggtgaaactccatctctacaaaaaataaattagctggggccgaggcaggcagatcgcctgaggtcaggagttcgagaccagcctggccaacatggggaagccccgtctctactaaaaatacaaaaattagctgcacatggaggggcatgcttgtagtcccaggtattcgggaggctgaggtaggagaatcacttgaatccaggaggcagaggttgcagtgagccgagaccgcaccactgcactccagcctgggcaacagagcaagactccatctcaaaagaaaaaaaaattcgccgggtgtggtggctcacgcctgtaatcccagcactttgggaggccgaggccgaggcgggtggatcacgaggtcaggagatcaagaccatcctggctaacacggtgaaaccccgtctttactaaaattacaaaaaactagccgggcgtggtggcgggcgcctgtagtcccagctactcgggaggctgaggcaggagaatggcatgaacccgggaggcagggcttgcagtgagccgagattgctgcactgcactccagcctggggaacatagcgagactgtctcaaaaaaaaaaaaaaaagtcaagaagcagaggatcaggaaaaacaactaaggggtactaggcttaatacttgggtgacaaaataatctgtacaacaaactcctatgacacacggttacctgtgtaactaacctgtacttgtacctactttttggtttgttttggtaacaaaacaaaccaaaaaaaagatagctggggccaggcatggtggctcatgcctgtaatcccagcactttcgaagaccgaggcaggcgcatcaccttaggtcaggagttcgagacaagcctggccaagatggagaaaattccacctctactaaaaacacaagattaagtcattgcactccagcgcctaggtgacagagtgaaactctgtctcagaaaaaataaaaaataaaaaaggggccaggtgcagcggctcatgcctataatcccagcactttggaaggccgaggcaggcaaatcacctgaggtcaggagctcgagatcagcctgggcaacacggtgaaaacctgtctgtgctaaaagtacaaaattagccgggcaaggtggcacatgcctgtaatcccagctactcgggaggctgaggcaggagaattgcttgaacctgggaggtggaggatgcagtgagctgagatcgcgccattgcactccagcctgggcaacaagagtaaatctccgtctcaccaaaaaaaaaaaaaaaaaaaaagacagctggaaaatccccaaatacatggagatgaaacagcacatttccaaatttaaaaaacaaaagtacaagaagcttagtcatcgttcagggtcttccttgcaagatgagcttctacttactccactttctgcagatgacaggtgctacgggttacgtggtcacaaagaatccgcacagaagagtcactcaggaagctttgtttcacttccagaaacttgaggttgctgtttgagctgaagagagagcagaaatctgtccagaggcgaagagagcgaagatcctgccgagcccagttcggaatggttaggtaagtgcacctgcaggagaacacacgttcatctcttaggactagtacctgcatggtgagatgggcatctgcaaaccacatttcaatggcaaaaaccacaattacttttgcaccaacctaaaacagtgtctatagtaaacaatattgcatcacatgctttgctaccagtatagatcttaagttttacaaaaaaaataaaataatagataaggctgagtgaggtggctcatgcctgtaatcccaacactttgctaggccaaagtgggaagatcacttgagcccaggagtttaagaccaacttgggctagaaactgagacccccatctctacaaaaaaataaaataattaaccgggcaaggtggtgcacgcccatagtcccagctactcgggaggctgaggcaggagaatcacttgaacccgggaggcggaggttgcagtgagccaagatcgcgccactgcactccagcctgggggacagagcgagactccgtctcaaaaataaaaagccccaattcctaattgccaagtcgtgtctccacgttgaacatgaagctggaaagaagtccagccagagggaaattctgacagtaagcgacagggcaaaggagacgctggcctcttcctagtggagcgtgggatgggaaaacagttcttacctttcaaattcaatgtccagttcaaaatccatgtaattctccaggaacaccccctttgctacctgcagtgagagtttctgcaagtcttgacaatgcttcaggctgaaggaacaatgcatcacttcagaagtatttgtcaggtgaatagaaatttccttgaacggggccaccaccaccttcgccagctcctcctcctgagactcatacaggcagcccaagacctccttcaggtcggtcacggataagggcttatttgcatgaagatgtgctttgcattgcagcaattcctgtttgatgtccggtgacatccggcagccaaaagtggcctccaactccttggctctcttctcgttagcgaggccgaataagaagtgtcctacttgaatcaggtcggggttcttgagtctttcttctccggaaagcagcttctgtacgtccccgatgtcccaggcgtggccgtccctgtcctccccctcctccttctccagggcgtagaacagggcagtgagaaactgctggaagctgaggtggatgaaggagtagcagcctttggagactctgtcctggcggaggatgtctccgtccaggaacagacggaggtcggactcctgcaccccgagcctttccaggtcctctcggtggaacacggacatctgcgcccacaggccctgcgcggccaggaggctcagcgtccgcagcgcgccccgcagctgtgcgccctgcgggaaccggctgcagaggaaacgcaggaacagccccgtgcgggtgaggcaggtggggaccgggtcctcccccttctccatctgcagcttcagagtcgtgcacacaatccagcacaccgcgggggccgagcccagctggaacagggccgcgttgctcctcattagctcaaaggcacgcatggcttggtcctcgtctccaaagtgtctcaggaaataggccctcctgtcctcctccaggaagccctccacccttacgtagatcggctgctgcgccaggagctggaggtccctcagtgccctgggccgcgtggtgaccagcaaggctgccctgggtaacatcttcctcttcagcaaactccccaggaggacgggcaccggcttcttcttctcccagtccccgcagatgtcctggatcagcgccccaggtgggactttcagctcatcaaggccatcgaccacgaacaggattctctgtgcttgggctaggatgcttggaatgtcatcctgcaattcaggccagtctttggagatcagctctgcaaaactgcaggggcccatgcggctgagctccttgcagctgaggtagaacgcgtatctgagcgtcgggctgaggttgcagtctgtccagtccagcatacactttttggccagcgtggttttccccacgcctgcggggccgtgcagcaccaccgtgtaaggtgttagcttcctgggtgttctgggattcaagaatggaatgaaccgttggtttctcagagtgacgtcgtcatggaaattgtcaatgtctccttgccaaaaggtgttcttccagaccaaagactgtttctccattgaatttctccatccttccttttcacctgcagtgacagcccataggacagttgaggttgatgatgatgattttctgaattattttgtcaagtaccagaaatgagggccaggcacggtgtctcatgcttgtaatcccggcactttgggaggccaaggtgggtggatcacttgaggtcaggagttcaagaccagcctggccaagatagtgaaaccccatctctactaaaaatacaaaacattagctgggggtagtggcggccgcctgtaatcccggctactcaggaggctgaggcagagaattgcttgaacccgggaggcagaggttgcaatgagcagagacggagccactacactccagcctgggctacagagcaagattccgtctcaaaaaaaaaaaaaactaccagaaatgaataaaaccaggaagaagtgatgcaccttgcatgctctcaaacaccaaactcatgaccataggaccgtatttacccacctggctttgctaactccgagtcttcttctgcatctcccagctcaggattatctatttcttgcacctgtccgtcctctgtaaaatacttagatgtaagcctgacacagtaatttacacttcgtaaatcagacattattgtacataaagtgtcagccaggcatggtggctcatgcctgtaatcacagcactttggaaggctgaggtgggcggatcacaaggtcaggagatcaagaccagcctggccaacatggcaaaaccccatctctactaaaaatacaaaaaaaaaaaaattagccaggtgtggtgaaacacgcctgtaatcccagctactccggaggctgagataggagaatcacttgaacccagaggcggaggttgcagtgagcccagatctcgccactgcactccagccttacactccagcctgggcgacagaacgagactccatctcaaaaaaaaaaaaaaaaaaaaaaaaatgaccaggacaccccaggttctacttacccatcatctcagcctttgccatcttacacaattccgtgagattcatctcttccaagatgttcacagtcgcattccttatccaattttctgaggaggtgttgaccagaatttctgccagtttcttgccatcagcctcttccacctcagaccatggggtcttctgtagcacgtcttcgaggggaaaagcccataaaagggatttgaaactctttaattcatcctcgttcagctgctccagaagggtctgcagagtccactctagctggggcgatgtcatagtgctccgagtatgagaccttaggttaaggctgaagaactggggggaaaaaaggaaaaacagttcacgagttaccatcattaaatgaaaccacagtttcctgtgtgccaagaacaagactgttcctgctgtacagtgagtggtaaaatattccaaagactgaattaagagactgaaaatctggcccagcacggtggctcacgcctgcggccaggagttcgagaccagcctggctaacttggtaaaaagaacgaacaaaaggctgggcacggtggctcacgcctgtaatcccagcactttgggaggccgaggcggatggatcacgatatcaggagatcgagaccatcctggctaacacagtgaaacccctgcctctactaaaaaaatacaaaaaattagcagggcgtggtggcgggcacctgtagtcccagctactcgggaggctgaggcaggagaatggtgtgaacccgggaagtggagcttgcagtgagcagagatctcaccattgcactccagcctgggcgacagagcgagactccgtctcaaaaaaaaaaaaaaaaaaaaaaaaaagaatacaaagaatgaagggtcagtggtatgctagggccagcccgtgctgcctaatgggggcttcctatatgtacctataccaacgtccatgggctgtgatttcacactgatagtacaaaatcacaaggggagtgtttatgccacagaaatcagcaaacacggcagggcgcggtggctcacgcctgtaatcccagcactttgggaggccaaggcgggtggataacctgaggtcgggagctcaagaccagcctgaccaacacggcgaaaccccatctctactaaaaatacagaaattacaggcgggtgcctgtaatcccagctactcaggaggccgagacaggagaatcacacttgaacctgggaggtggaggttgcatgatctgagatcacgccattgcactcgagcctcggcaacaagaacaagactctgtctcaaacaaacaaaaaaacaaatcagcaaacactacaaaccaagacttcctcgccaccaaccctcagagccacttgtttaacatttcagcccaccactgaatgacacattgaaaacaaatagcaagaggacagatataaatataactgtactggccgggtatggtggctcaggcctggaatcccagcactttgggaggctgaggcaggtggatcgcctgatgtcaggagtttgagacccgcctggcccacatggtgaaaccccatctctactaaaaatacaaaagctagccaagtgtagtggtaggaacctgtaatcccaggtacgtgggaggctgaggcaggagaatcgcttgaacccaggaggcggaggttgcagtgagctgagatagcgccattgtactccagcctgggcaacaagagcgaaactctatctcaaaaaaaaaaaacttagccaggcctggtggaacatacccgtagtcccagatacttgggaggctgacacaggaggattgtttgagcctacgatttggaggttgcagtgagccagccactgcacgccagcctgggtgacagagtgaggccctgtctcaaaagtaagtaactaatggccgggtgcggtggctcacgcctgtaatcccagcactttgggaggccgaggcaggcggatcacgaggtcaggagatcgagaccatcctggctaacacggtgaaaccccgtctctactaaaaatacaaacaattagccgggcgtggtggcgggcgcctgtagtcccagctactcgggaggctgaggcaggagaatggcgggaacccgggaggcggagcttgcagtgagcggagatcgcgccaccgcactccagcctgggcgacagagcgagactccgtctgggttgggggggcggggggaagaggcagcctggaaaataaataacagaaaaagtgacttgccaagcccgggtgctgatagaggtggacagctttacccttggagggaacagcaaatctttttccccagctgtgacgtgtggggaaaaggaggacagatcagactgttactgtgtctatgtagaaagaaatagacataagagactccattttgttctgtactaagaaaaattcttctgccttgagatgctgttaacctgtaaccctagccccaaccctgtgctcccagaaacatgtgctgtgtcacacgtgggtttagggctatgcaggatgtgctttgttaaacagatgcttgaaggcagcatgcttgttaaaagtcatcaccactctctaatctcaagcacccagggacacaatacactgcggaaggctgcagggacctctgcctagaaaagccaggtattgtccaaagtttctccccatgtgatagcctgagataaggcctcgtgggaagggaaagaccagaccgtaccccagcccgacacccgtaaagggtctgtgctgaagaggattagtataagaggaaggcctttttgcagttaagaggaaggtatctgtctcctgctcgtccctgggcaatggaatgtctcggtgtaaaacccgatggtatgttccatccaccgagataggggaaaaccgccttagggctggaggtgacacatgctggcagcaatactgctctttaatgcaccagatatgtttatgtatgagcacatcaaggcacagcacatttcctaaccttgtttatgacacagacatttgctcacatgttttcctgctgaccctctccccactgttaccctattgtcctgccacatccccgtctccgagatggtagagataatgaccaataaatactgaaggaactcagagacccggccggcgcgggtctcctgagcccacttttctttctgtgtactttgtctctgtgtctctttcttttctcagtctctcgtcccacctgacaagaaacacccacaggtgtggaggggcaggccaccccttcagtgaggtataattacatatatcctattttaggatggagcaggaagagcatgagagcccaggagttccagaccagcctgggcgacacaaggagaccttgtctctattttttaagtatttttaaagtaatatatacaacgtttacttgtcaaagtgtacagcatggagcgatgttatatatacagtgaaatgattaccacaatccagctaattaacatatccactgcttcatatagttgcctttcgtttttgcagtgacaacgcttgatgtacttagaaaaattcagggttttttggccaggcacggtggctcacgcctgtaatcccagcactatgggaggccgaggcgggcagatcacaaggtgaggagctcaagaccatcctggctaacacggtgaaaccccgtctctactaaaaatacaaaaaaaaaattagccgggcatggtggcgggcgcctgtagtcccagctacttgggaggctgaggcaggagaatggcttgaacctgggaggcggagcttgcagtgagccaagatcgcgccactgcactccagcctgggcgagtgagactccctctcaaaaaaaaaaaaaaaaagaaaagaaaagaaaaattcagggttttttttttctttttcagaaagtcttgctctgtcgcccaggctggagtgcaatggtgcgaggcttaccacaacctcctcttcccgggttcaagcgattctcctgcctcggcctcccaagtagctgggattacaggtatgccccaccacacctaattttttttgtatttttagtacaaacggggtttcaccatgttggccaggctggtcttgaactcctgacctcaggtgatctgcccacctcagcctcccaaagtgctgggattacaggtatgagccaccaggcctggccaagtattttttttcccaagtacatttttttctttttttcttttttttgagatggagtctccctctgttgcccaggctggagtgcagtggcacaatctcgactcactgcaacctccacctcccaggttcaagtgattctagtgcctcagcctctcaagaagctgggattacaggcgcaccgcatcacgccgggctagtttttgtatttttagtagagacagggtttcttgtttttttctgagatggagtcttgctctgtcacccaggctggagtgcagtggcgcgatctgggctcactgcaagctccgcctcccaggttcacgccattctcctgcctcagcctcccaagtagctgggactacaggcgcccgccactatgcccagctaattttttttgtatttttagtagagatggggtttcaccgtgttagccaggatggtctcgatcttctgacctcgtgatccgcccgcctcggcctcccatagtgctgggattacaggcgtgagccaccgcgcccggccgagacagggtttctctatgttggccaggctggcctcgaactcctgacctcagctgatccacccgcctcggcctcccaaagtgctgggatcacaggcgtgagccaccgcatctggccatttacatttttttttttttttgatgcagcatttcactctggttgcccaggctggagtgcagtggcgcaatctcagctcaccgcaacctccgcctcccgggttcaagtgattctcctgcctcagcctcccgagtagctgggattacaggcatgtgccaccacgcccagctaattttgtatttttagtagagatggggtttctccatgttggtcaggctggtctcaaactcccggcctcaggtgatctgaaagtgctgggattacaggcgtgagccaccgcgcccagcctacttttttttttttttaaacagggtcttcatctcatccaggctggagtgcagtggctcaatcacacctcattgcagcccccacctcctggctcaggtgatcctcccacctcaccccacaagtagcttggacacagcacaaggtctggccttctttgttttttgagacggagtcgcactctgtctcccaggctggagtgcagtggcgcgatctcagctcattgcaacctccccctcctaggtttaagctattctcctgcctcaaccttccaagtaactgggattacaggcatgcaccaccacacctggctaatttttgtgtttttagtagagacagggtttcaccattttgggcaggctggtctcaaacttctggcctcaagtgatccacccgcctcggcctcccaaagtgttgggataacaggcatgaaccactgtgcctggccttatatttttttgtaatgacagagttttaccatgttgcccaggctagtctcaatctcctgaactcctctaaactatatttgaatagaagtccttaagacattaggccaggcgtggtggctcacacctggaatcccagcactttgggaggccgaggcagacagattacctaaagtcaggagttcaagaccagcctggccaacatggtgagaccccgtctctactaaaaatacaaaaattagctgggcatggtggcacgtgcctgtagtcccagctactcaggaggctgaggcaggagaatggcgggtgaacccaggaggcggagtttgcagcgaaccaagatcacgccactgcactccagcctgggcgacagagggagactccgtctcaaaaaaaaaaaaatcaaagatccttccagcatcctcgcaccaaccattaaggcttgggaagggctatggtggaaactcaaccaatagcttcttctcccttaaacgagaagacaaagaaatcgatgcaagaaccagcactcacctccctcaggtcaggtcttgcttccagcctgtgtttc

SEQ ID NO: 423 - DNA, 23998 bp, Homo sapiens; identical to SEQ ID NO: 422

SEQ ID NO: 424 - DNA, 23998 bp, Homo sapiens; identical to SEQ ID NO: 422

SEQ ID NO: 425 - DNA, 36823 bp, Homo sapiens
taaagcggcggggagctgccaccccgggagcgggctgcgcagtgtccgggccgagccggtgcgccgcagactagggcgcctcgggccagggagcgcggaggagccatggccaccgctaacggggccgtggaaaacgggcagccggacaggaagccgccggccctgccgcgccccatccgcaacctggaggtcaagttcaccaaggtgaggcgggcgcccctcccacccgacggccgcgggcccctgcgctgggcagccagactcggggcggcgggggcgagggagcagcgggccgggggtccgccgggcgccgccgagacccgagcctccctgcccgggcgcggctctccagaaaccgcacctttcgcgggacgtctcgggcgggatcgcaggcggcggggctcggcgctgtgagcctcgaagccgggaaaccgaggccgtccagcgcccgcgcggggccgggccgcccgcatccctgcgaggccccgacgtgtccctgcgctgcccgctttgatcgcgagtggaggtgcgcgccgcgttgactcggagcgcgctggttttggggagctccctccccaaaaacccctgcgatgatttccagggtggacgagtctggctttgagagggtcggagggtccgagagcgccaagagagagtccgggaggcagatggcggagctgcagttggaagactggggaagcgggtcctccgagcaaagcgcagcgggcgccttccgtgcttagtttatacccggctcagcagcagaacgaggaggagtaggaaggtgctcgcttactgacgaaacctccccggagcccagaggtcccggtgtttacacacaaggcgcgcgctccggaaggtcgcagacctgggcctttgggaagcggtgggtcgcgaggccgcagaagcgcacggttctctgcctcctcgctctgtgggctgggaggctacagcgttggcagaacggcgagattacctgcccggggcagaaaggaataaaagaagatggtgaggcctccgaggcctctgagctggggctgaggagggccgagagacccgggtccgggagcgcgacccgatggaggacacccccaggctgtctggcgtgcgcgtctgtcgtgggccggtgctggggcactttagaggcacaggccaggccgagagccattgccttaactttccccacctttggcttctcttgatttttgcttttacccatagcccccaactccagctgacaccgcacttagagaatttcctcatccgttttactttaagaagtagcaattatctttctcaaagaattttaatcaagcggagaaagttgcagggcactatgtgtggccttcagatttgggtctcttggcacttaattcccaatgtcggctgagcctctgatcacaagacatttaaattaactgttttcagaaggctctgtaatcaacaaagacacgtcgctgtaaactaaacgctggaaattattcttaatgtagttttatttgtaatatcagcttcagagtgaaaattccaacacgaattctgggaagagtgaaaatggtacccgaattttgtaagaccctaaccccaggtgcttggctgctgctactgatggttaagtggggaggttgtttgttttcttttggttgtacaggatttcaaaatactgtatatagaaaccagacagtaaatgtattatggtccttttactttttatgtttttgagtcctatcagcaatctgaccacatacaaaaagtttacctctttctctatgatttttaggacacttttaaagtgtagatgtagcccttatggagaccttagacaattcacagagcaatggttgcctgttgtcttggtgggtgcgcaacctttgccagttaaagggaaccagtgcaggaatgaggctgagggaagctggtggatcggcctggagtgctgggatcttgagtggtctcccaggcgataaaggccccaactgcctgacaccggctgctggctcctcacccgttgggggactgtgctgctgcctgctctgtcctggctcctggcccatctctgcagagacctccccatagcagttgtggacccaggcagcttgtgtggctgagggtggccaaccagtgccctggcacagtcctcagggagactggactggagaggcggccgagagtgaggccaccaagagtgcctgccgagggaaggagcgggataaactgaagtgcaggactgaggcccagagtgggcgagtggcccggcaggtgggtggcctggcaggagagcagacggtggagcatgggagccagcagtggtctgctattttccaaaattgactcatggtgcttctcgataatggggcacacaccagagttggtccatctgagccctagccccggcagtgccatttcccagggtggtccaactttcaggatgactttgtcaaagccccttcatttgtcctcacatgttaacatttcattctctagggtcatgctgtgtgattctggagagctgagagcccctccagggtccccacacagatctcagaggatagaagtcccttctaatttagagggcctctttctttccttataaaatttcttccagtagcagggattctcttcaaagttttctgatttttaaaacaccggtttttattatctctcttatgaaaaataaaattcccccaaatctccttttctgaaaacatattctttttgagtttagctgagtggcctgttgtcagatggaagttacgggaaatcggcatcaataggattcacttgtatgactgtcatcttcacctctgcctgagacaccttacagctccgtcctgcttccatgtcattctgttccttttgtaaaatgtgaaccaggtctacagctcaatgtagcttaatgctatacctctataaggtttgttgtatgctaatccacaaatcaaagacaacaattccttctagaccctttaccctgatttggagttcaaaacaatacagccagcataatcagtagaccatatttatataccctttccttatatttgtgcttttgttttgttttaatggagagaaaaatcaacagtagaaaccacttacaagattacttactactgtagtgtggtataaagtaaaagattttacaaaattaaaaacatagtgatgggaaaatatggttagagtcaaacagtctgatttttttttaaggttgctggttacagatcaatgtcatgaacaaacagtaattttttttggaggagcatgcttggagatgaagtatagcagtatagcagacatccgatcattgtaatctgttttcagcccccttatttatattctcttctgccaccttctcattttccctcccccttggagttgataccaggaaggacctagaatcagcaattttcactgacagtctctattatctaacccacgaaatttcatctttctacaaatgggcccctcttcctggctgcactttcctccccgcactaacttaactcttcttcctcagttattaatttctcgctgttaccaagtgatgacttgctggatggcaaaagtgaactcttggatttagtttcagctggaagaataaacctgtaattgtagcctggccttttcctggtgcgcttccctgggggcctggcctcacattggagacgctaagcttccagaagccagacaggcaaatcccaatggtgaccgatgctctcagttctggattccaaactggggggcagctggtctctgctcacctgcccagccagagtctgcctcctgtgcttggtccccaaccgactcagaccaggcttcctcactatgagcttcagaggtttttgtgggttttttttttttttaacattctatcaacttttaagttctggggtacatgtgcaggatgtgcaggtttgttacataggtaaacatgtgccatggtggtttgctgcatggatcaacccatcacccaggtattaagccggagctgtggagtttatacaggaagcccaatacagagaatgtaaccaagactcatgcttaggagatggctgccctctctcatctgtcatcactggggagtcaaatgtttcaaatgaatcaatttcacaataattgaaattagcccttgagggacgcaattcttcctttaaacaattcaaaaagaagcaaagtaaagctatgtataccacatgcagatagatgtaaaaacggaacctgatgaactaattctgtactcagaaattactgacggcattttacttgagagacatgcgtgtcagccatttctgccacgggggttcttctgatgctgtgataggctgtgatgaggaagccattccaagttggtgtagcaggagtttgtgtgtcttctggctgggcagccggggacctccgtgctgtcggaatgtgttttgtatattgtctgtcatgtctcttcctagttttttccaaaagccctctcttttaatatgacattaataagacaattagaacttagtgtaaactaacagtaaatagtacatatgtttcagtgcatggacttcgtatgttcttcttagtctgctcatgatgtcttttgtcaaaaaaactttcattctcatctgcattctggatcattgaggttcccagaaaagtgatttctgcgggttatataaacagttatttgcgacatctcttaatgtaacctggaaagtttctaacccagacatttaactttgtacttcaacgctggtttattatcaagcttcggaggtttttctgggtttttttttttttttgacattttatcaacttttattttaagttctagggtacatgtgcaggatgtgcaggtctgtgacataggtaaacatgcgccatggtggtttgctatgaaaatacacattttaaggggaatgtgctggggagggacatgctgatgtgcattggtgaaaactgaagggcgatggtgagatcctcctcaaagtgagctccttggcaatcaatcttgctgagtgttgccactgaaaggagaaagggagtgctcggtgcgtccttacccttcaggggcaggcggactgcttgggacttttatgtatataaacctattgactcttcccccaaagtctattggggtatgagattccattcacagcctctatttaaccatttaacttagccattcctctgtgaatccatgttattgctgaagataataataataatttagaaaaaaatctctaagtgactatagttttatttgaccaaaacttgaatttcgagtctgtcctagttgatctgttggtcatgcagtcctgggactctgttcccctccgggtctcatctataagatgtcgaaggggagagggaagcagcagagaggaaggtggacaagatggataagacgtcacctaaggtccttagcatgttgaaattatatgattttgatctaaacctaattggttacacttcctttcctggttagatatttatcaacaatgaatggcacgaatccaagagtgggaaaaagtttgctacatgtaacccttcaactcgggagcaaatatgtgaagtggaagaaggagataaggtaaatacttaaaataaatttgctctaagtaattcaattatggatgaccaaaggataaggaaacggttcggcttagctataagacagaactggcctatcctgggggcagggcctgggctagctgcgtgaattggcatgtggttctcagacgtgtggcacagaatggcatcaattaccgatgatcctctgcagagaatcattctcccttgatagatgtttctcctactatgaggatgacctcagctatcctcatcatatggctaaaggaaaggttttcttttttcttttttttttttttttatcaattatttggacctggaggcattaaagaatctttccagaaagcatttcccgctggtgtgtttcacgaaatgaagctttctggcagaagacactttagaaaaaaatagacactttgaaggaaaaaaaatagttgctacccgggtgatgcggggatagttaacaatgtaaccaccagatttcttttctcctagaaatttacatgagcatggaaagcggtaacctttatcactctatttgcaagtgcaaggtctatatagtaatacagaagctaagggacttccgaatgtgtcctttatacattgcaaggccatcaaatctattctgaatgtcagtgcagaggtaaagcccttccactgagggcagggagatgtaaatgtttccttagctgctggagtgctggactgatgttcttggtcagcaaactgatgacgttggaagtggatgcagtgaagggcgtgtgcagagtaggcttggattttatcttgcccatgagtttttgtgacagacgtgcaaatgcacactggccccacctatacagacccccctctgtgtggcacctcatgacagttaggctctgctaacaaagaaagtggcacagaggagctcatagaaaaatgtgagggcattggggggaagccatgacatggaatggggtttccactaggagactcccaagtgccccgtacaggtgctaggaggagaacgagacccttgccctgggccttgatttctcccttggtctgagtgactgttctgagccagaggccaccacaccctctgcagctggaaaggtcctggcctccaccccagagcctgggagaagaaattcagtgtcccacatctcccctgccaagcttctgctcacccccaagccagctctggacacacagagactcggtagagtcactcctgactggtgtcccacatccactccctgctgtaccttcctagaaagagagaggcatggaggggccttcgagatgaatgtggcccattttcctgagaaaaagagacagtgacactactctaaatggccctcacttctttccttttagaaagaaggttccgttgtgattattctatcagtgcacaaaagatccagttctgctcccatggggtgggtgaggctgaagggagaaaaacggccttcatgctcctccctgtctgcgaactgttccacgatggtcagttctgcaatccagaaaggaaggaatttccccattctcactcttggaccacaagttcccagctgggatcaaatgccaggcagacacttcccacctgatctgtgaacagcaggctcgtgtgcgttcacactgaggcagccagtggaaagtccttccgtacttgggtccctgagaaaaatactctttaggaaatatttttaaatgctttttataatcagaaacaaacattggtatttggccactgtagaaatattaagatgtaaagaagaaaaaaaatcacttgaacgctcccagccattcaagtgattgaaaaacatgctgctgcttgcagcctgtctgccagcgggacaatctgctgttctctataactgatggccgtggtcccaaactgcagtcacgtcaaaagatgacacccaaactgcagtcacctcaaaagatgacacccaaactgcagtcacgtcaaaagatgacacccaaactgcagtcacctcaaaagatgacacccaaactgcagtcacctcaaaagatgacaccgaaactgcagtcacttcaaaagatgacacccaaactgcagtcacgtcaaaagatgacacccaaactgcagtcacctcaaaagatgacacccaaacttcagtcacgtcaaaagatgacacccaaactgcagtcacgtcaaaagatgacagtctctctctgttgttctggtcgctcagcccgacgtggacaaggctgtggaggctgcacaggttgccttccagaggggctcgccatggcgccggctggatgccctgagtcgtgggcggctgctgcaccagctggctgacctggtggagagggaccgcgccaccttggccgtgagtacatgcacttgggggccggtgggggatgagccagcctcactgagggtcctgtccaccatggggtatgggaaaaaagatcacggtcctggttttgtgtggtcgtgggtctgttccatcctctgagacacggctctctggcaatacttgcaggtgttaatgcctctagactgaatccctttcattttgaagtcagacttttgtcctctgcagctcagcttcttgaccaagttgttgtctataggcagttgagctacatcagtggtctcagacttggggcactcacagattggtgaccatgagctgggccatatcctggtaccacctgtgtgtttatgtacttaacttttttcttttttgtataaacttccttttatttattttattttatttatttttttgagacagagtctccctctgtcacccaggctggagtgcagtggcgcgatctcggctcactgcagcctctgcctcccaggttaaaatgattctcttgcctcagcctcctgagtagctgggactacaggtgcctgccaccatgcccggctaatttttatatttgtaacagagacagggtttcatcatgttggccaggtcttgaactcctggtctcgaactcctggcctcaggtgatctaccggccttggcctcccaaagtgctgggattacagatgtgagccactgcacccagccttaactcccttttaaacttaagtttaatctcatcctaagaaacaatattcatgaaatcacaggtttgatgtgctaattttatttttctaatacttaccaaaataaatgccaccacttaacatagaaaaaattgttcccatgtgacctaaaatcattcctcagtcacccctgaactggctagtagcgagcatatgtggagcggtggtgagggcaggatagcctggttataggaaacctcagaataggaaagacctgggttcaaatccccactctgccacttactagctgtgtgactttggacaagttgtgaaacctctctgagatttatttcttcatgtaaaatgtcaccgataatgataactcagtggtgtaagaatgatctatttaagattctaggcagagtccctggcaggcagtaagcactaaatagatgacagctatcattaataatagcagttatcataatgaggtcatgtgaagacccattttctaacctcacctacatgcactgctggccagtaatttctagataccctaggtggggatattgatggagcataccccatgaggctgagctgccaaggcattcatcagttgtaagtccattttttagcaggatcctcagaccctcctctggtcatgagggagtgatcagaggacatctcagggccacgttgggccatgaggtcctttgcatcctgtccttgcccatctcagcctcttgtttttaaaagttgttccaaaccttgaggcccggttgtaggggaggagatctcctttctggcctttgatttggaaaaatggtttttctgatgtcgggaacaagcagtagggtagccactgtttaaaggagggtgtcagccaggacacggaaattgctgttgcccctgaatgtgtttctcagggtggaggaactctcaggccgtactcttgggtgcatttccctaagggtgcatccacacagaaactcgagctccccttccttccttcccagtcagcccggccagtccacatgttccccgggtgagagtagctccctcccagggtaagcgcttctctctgaggagcctctggtttcttcctgcaacgtaagccagcgtcaaccctcaagctgccaaactggctttttcaaaaacatttctgttttcacccggcatgagctcatcggtcggcaatgtccgtgtggactaatagcaggctagagaggatgtgccctgggcaccccccgccctgaaccctgtccttaagtgtcagtatcatcttaggagcagaggctacaaagccaccttcatcttcaggctgccccattgtcctggcacgactgtgttttgatagcagacagctttggaggatctcagaatgcaaacccagcaaatcacttctgccactggcacctcgcagcccacgagaaataagatccagctctttgccacaacatgaaagggacaagagaattactggcaaacacggtttttaaaactccaaccacatcacaggagagcgccccttgctctccacctcgatatggtttccgtgcatgttcatggagcgtgttctcttgccggctcagtggtttgacagagctgggtgtttatttctgtgctcagtgtctggaaacagatgtgggggatccagcggcccctggatggctttcctttgctggggcacccaggccccaactctgctctttgggcgctcattttgggagctcccaaacggaagccctccctatccactctccttttcaccccaagtgccatttctgggtcctctcgttgtaagccctgccgtgctgttttcctggcacttcccgtcattctttagtatctgagggttctgatgtgttaatttctcaggaggcacattttcctcttaaaatgttaaaggaaataaacttaggagtggctatggtttactcatgattgagccacagtaacaagttgtttaaaggatgactgtttcaatctgtagcgagcacttggactcactcacctgcataattttttttaataatttcccgtctaaacctatcatgacctgggttttgctcagagaaattccataaaactaacctggtaaattcatgttgtcactccagtaagcaaacttgctgaagttgacaataaaaacaaatagcaatgctggctgaatgttcgccatgtacctggcttgttgacctgtaggatttattatctcatttcagagatgagaaactgaggcccagagaggttaagtaacctgtcctaggtcacccagccagaggtggtaatccaggactggaggcagaatcttggctccatgtctcgcgcttaccctcagtgctggatgttgaagtcctctctcttgttccatcccagaaaagagcaaagaataaacttgcaattccactgacagatatgcagatactgtctggaataggtcagtcttagaggcctttttgcactatttgcaattgctaggcttcccctggaaaaatgaaagttcacgcttgagtgaaaatctataggaaccaacactagagtatacttgatgtcacactggcctgactcagtccctgagtggcagctgctgggggcagaacacacaccccaagctagaccagtcctgtggtctttagcaacccagtgcgctgtctgggtccccaggtgaggatcgccaagcccttctctggtgcctaaagggaagttgatgatagtcagtgtaatcatcagtgttctcatgtgaacaccaatccagcactcaccatgggcgggcactgtggttgctgctctgtggacactgactcctttcactctaacgctggccctgtgaggtaggaaccgttattattcttattttacagatgaggaaactgaggcaaggagtgattcagggacttacccaaggcccacttacttaactagggttcagcagatgtagttgcctcctatttaaagggggcttggctcattcctgaagcaaaggggagctggggtagcccgagcatccggagtggctgccctgcagtctttccagacacacctgtccaggagcagcctgtaaaggccagtcgctgtgctggccagaagtagatgcccccaattcagctgctgcattactgggtggccttggccaagtcactgggccgttagcgtccgtgcctgcaccttgaagtgggaatgcagtcatggagctcaaagggtgagacatcggggagtgcgctggggttaaagccctggatctgaggaggggccttcttcctttttcaatcaccatctcactccactgactcttccacaagaatccagccctgggctatgtgtcagggcggccacttcctgcagaggcggatgactggcggtttcagcgctgggctcaactggggccacttgtctgagggacaaaggggttctcttccaccccggctggaaatagaaaagaatccctgccattgagtggctgcacactcgccctgggtaatcacctccctcaccagcagggcagtctgctcccttccgactctgcatccggccggccgggctctgcagtgcaggagggaaggattgcatctttgtgctgggggcgcgacccttctcggctcagtcactttccacagccacactggccagcctggccgagaaggaagagcctacatcttctctttctcttttgttcgaggagggcagctcccactgcagccaccccagagccagctaaccttcagagagcttcctgggaacacacaagcacacacgactggccacacagcagaggccactgtgctacagatggaagatcagatgccagtgtgcgttccttcccagcacagctttaaatccgcctggcctccaaggggcccttcaaagagggtgcatgtctatgttttagcccaccaccctgcagcccactttaggtgttttgaaataaaagcaatcctcacactcagagacaggcctcgctttacatttggtgtcatgctttctgaagaggtgcatctgactgtgaggtctacagagcaatgtcctaggactgtgttctctccccaacttccatctttaacaacctgacagtgcaaaagaaaagcaagctatgtccgaaacagacatcatcttgttattgcaggccctggagacgatggatacagggaagccatttcttcatgcttttttcatcgacctggagggctgtattagaaccctcagatactttgcagggtgggcagacaaaatccagggcaagaccatccccacaggtgagcaaggtggattatagcttcatttgggatccctttggggctatatcttttcattaatccagagccccccctgactgtttccctaaggcaccattcccaaccccactccctctccaaatggtactgccaattcttcttctaagaacttcacttttaaagttgaggtcaaatcacttctctgtataatagacaagacttgaatctggcacccttgttggtttctttcttgtctttttactacttgaagttcctaacctggactaagtgagtgtgtccttccccaccatgtaaccctcttccagatgacaacgtcgtgtgcttcaccaggcatgagcccattggtgtctgtggggccatcactccagtaagtatggcagcctttctcagtagattctatgtagatcctgccccactgccctgtgtcctttggaatcaatttctggtgtgtttttatctgattgcaccagcgttgaacaagcattttcttcgtggcatggaactccatgcttgggggctcttgagatggattagaccccatttctgctctcctaagaccggctttaggcatgccacagaaagcactgtggttcccagccagagtggtcaggaatggccagcattcccaggaaggtggtctcttagctgggccttaaagataagaaagacttgttcaacaaggaaaaggattttccaaggagtgggaatggcctaggcaaaagtgcagaggtggctgggctacttggaagggaacagcaggaaagctggtggggctagagctcaggcaggagcaaaagtgaggaaaagggtgagcacacgtggcaggtggtgtgggccagcttccagcagctttggctgctaaggggccgggactttattcattgggcggtggggatgcttataggtgcccaagaagtgcaacaatgctgcctgtctgtttgggaagcctctggccattgcaacaacagccaggcaggaagctgaagagccaggtggcaacatgaagtgagggttcaaaaagtgcccatggaggcagggaggaggacacgtcttcagcagatgttttagagggagaggtagaacacatgcaacagcatcctctttgcaaaggctgcctattagtaccacccagaatgcagtttaggaagtgctgtgcaggattgcagttctgatcattgcacactcctatgttaccccacataccccaaatccagaccatgaaaagcaagtgtcctccacaaaggcatcgttgagcacatgggacagggtaagagggtggatctgggcctccaaagcccctgtgctctgtcgcagtggaacttccccctgctgatgctggtgtggaagctggcacccgccctctgctgtgggaacaccatggtcctgaagcctgcggagcagacacctctcaccgccctttatctcggctctctgatcaaagaggtgagacatccaaaaagaaaatatcacatgttcttggtaacattcccactcctaggaaccaggccaccgtcacgagatgggacagtggcagactgctggcaatcgagtgggaagggaatgacttccagtgttttgtttggcgactgcacgttctttctcctgcttgtggccactgagctggagaaactccattcctcccagtggtcctaatgagaatgcttaactcttattatgggctcaaacctatggttgaggacccagtggtttgtctagagaattttcagggggggtcaaccaagagggagccaaatatttgggaggttctctgggatttgcattctcagtttatgaaatggtccatttttctctggagaggtggcctcgtcagctctagctgggcggctgcagcagtccgtgtgccgggtccctgctaatcagtgccctctgctctgaatgcaatctcttctccctcaggcagccagaacttagggaaacagaggctcaatgggacacctccttccagacatacctttagtcattccatccccaggttgtatggagcaaagatttagagaaagcaacaggaagcaaagagggacagaagaaaagatccattcctttctcttcttagtcgggctgatatgaccggcaggcaggtccacagttgcttagaagcaaggtgggaacagctggtgatgagccaattttccactttcctttggtgatgtggggcataattaagtcacactggtgagacttaggaatgtgaaaatcccaactgttaagaaacagtgcctaaaaatctaaagactcaagcagcgtgcctaaaatcttgattttctgaaataatgtgttctaagtaagactcagcacaggtggggaagagcatcctccacctcgtttgttttgtgttctcgcctgataaagaggcttagtatatgaaaaacacgaggcatgaacgtgaacgaggtggcagtccctgccttccagaagggcttgctccaggtgagacccaggttgaacaagcaaagaactttaagggagtgataccctgtcaccatttggaataataacgggtctgattaaaaaatgaaaactgggctcacgcctgtaatcccaggactttgggaagccgaggtgggtggatcacgaggtcaggagatcgagaccatcctggctaacacagtgaaaccccatctctacttaaaaaaaaaaaaattagccaggcgtggtggcgggcacctgtagtcccagctactcaggaggctgagacaggagaatggcgtgaacctgggaggcggagcttacagtgagccaagatcgcgccactacactctagccagggcgacagagcaagactccatctcaaaaaaaaaaaaaagaagaaaaaacaaaactgaagctcttggcagatattttgcaggtgcctctgatcctgggcagggcattctgatcaaggtacccctctccccttaacgcatacacacactctccctcacacacacacacaccccacatggaaaggtgctgtgctacaggcgggccatggccaccttgaagcataaccacacatttgcactgcatatcactttgggatggggtccccccccagaaggagaagtgggcatctccccttgcccagcctgcacactgggctggcagcaggggatgagaagcccaggtcagctcccagggtgcccacggtcaactgcttctgggtcctgggtaaatccagcccggcccgggttccctgtggggatgtgaggcagccacggctctctcggcccaaatgtggatccgtggtggatgaagtccgttcttcttcaagtgctatcttgatttcttcccaggccgggttccctccaggagtggtgaacattgtgccaggattcgggcccacagtgggagcagcaatttcttctcaccctcagatcaacaagatcgccttcaccggctccacagaggtaaccctcctcacagggtgctggggaaagtgaaaggggcgtgttatttgacacccgtgagcttttcctttgacaggctttaatatgatttgtttttcttctaaatttgaccatgttttagtacataacaaccagttaaaaaaagtcactggtctagtttccaaactaaataaatatctaatagaactcagaagccttagaagaaaagattgagagataagataaagtagaaatgtaaaatattcatctgtcaaacaccataattaagattaagagataaataacaagctcagagaaaaatagtcgtgatgcatgcagtgctccaagaatttatatccgtcatatgcaaagtgctcctacaagtcaatgaaaaaaaaaaaccaaactgaatggtagaaaaatgggcagttcagagaatagaaatacgacgtgcccattaagcttaaactagtttgctggtaatcaggaaaatgcaaattcaaacaaaatcagactttccttttgcctgccagattgctaagaactgaaatgatactgctgagaatatggggaagcaggtgctcagcgacacttgccctaagatgcacagtgttttggtagcactcatccaacatttaaagtgaaaaacttttcgattcagaagctccatttcaaaaaaagaaaaaactacttagagaaattttctcatgaggcttcagggacatattttcaaggatattatattcattctctggaatgttttacagccgttacaacaaggaaagctgtccatgatctattgttgaagcacaaaacagcaaacggtagaaaattacccacaatattttcccattcgtagaggtgtgtgcttgtagaagtagaaattatctggaaggattcccaagaaatccttactgatggccacctatggggtgggctcggggcagagccggagggaagctgaaggctttctccctgtaattcacatacatctctatgtggaattacttttaatgagaaagtatttcttctgtacttaaaaaagaaaaaaacacccgctgcaatcagtgtccccatccccctccttagttagtccaagccctggtggatgctgttactctccttggagacagacactgccctgtggatggattccagacctcattcagccatcacccatgagcttgctgatgtttaaaatgcgctcacaccttagcattggagaaaacagtctcagacccggaagagcctgggccgcgccttgctagcttctggctctaggcctccgtgtctgcactggtctctgaggatcttcccagctctgaagttcgtggtgctgggctttacttgttgccctagataagtcaccgagtcatgctgggccagccctcccctccaggggtacagtgggcaatgggagagaccccgtgggggccttgagcatgactggtgagtggcttttctgctcatagcgcaccccttcactccctgcctgtctgcggcagcctcagtcttagagtgtgtttccagagaatcggctccttctcatccggaaggctggctgccctcgctacttctctaacacttggaggttccctcagatcacaccaaagagccacacagaaccacccccctactgggctgttggaatttcagctgtttctagtgagaggtagaagagtcaccctgcggtccctgaagccctttaccagactggctggaccagcctgctgggctcagaaggacaggcaccaggacaggttagcgggtggcagccctgttcccagccagctgtgtgggcttccagaggctctaactcacacctgtaagtggagcggcttagaccaaggatcccaggatgtcatggtctggcatgggaggagatgctggcagaggccaggacagtgaagggacggcatcggggcctggagcgcctgggccgagagccaggtggtggcactgccacccgggcttgatcagaatgttcactgatgtttacgcctgggccaagttcagcaacatccaaggtaaattgtgatctgtgttctgtcctggaggttggaaaactggttaaagaagctgcgtcccggagcaatctgaagcgggtgacgctggagctgggggggaagaacccctgcatcgtgtgtgcggacgctgactgtgagtctctgccctcctgggctttgctggggcttcagggcatccatctgtctccccctacttcctggcctgaattcaaaaccaactgagagtaagatgtgtgcacacacagtggggacgcttccaccgtgggcatcctgcccacagtcagccagccgcagacaggcaggtggacatcaaaatgccagctttacttctagcagaaagctgccttctactgccaaaacgatatggcttgagtggcacctgagaggctgcctgtttctgcgccttagcgttaagtttacctgcctgttcctgcagagctggggtcacgaggagcaggtctggcttctcctccagagccccctgggaggagtggggagggcaggtgctgcccactcccagtcattcattctcccctccaagtcacatttcctatcatatgttttaagatccctgaagagtggaggtgctctttccttgtgtctcagacctgataaatcagaggagggcagtagcaactgatccttcaaattacccgctttgcctggttctaggcctgcacccctgccctgggaaagcaacctgcccagcagtttggggatagcttgcgtcttgacagccaaacgacacagcgttaaaatatatgctattgttggctgccatgtccacaagagggaaggaagggctggccgggcattcattcacctgctgacagggtcagctatcaaaaggtgtgacttcccaagtgccttgaaacacctttgccttaaagaatagcctcccagacctgtccacgggtgccagaaattcctgtcgtggagaacaaagcctttcacttcacactcagataaggttggaattgcaaatatccccaagaaaaatgaccctggcacaatttcttactaaggtgtaaatgactgatatcagttcctttctggcagctggctttcacaatgggagaaaggacaggaggaggatacaggctctcaggaaggaaaggggagctgggtgtgaagatggactttccatttcttgcctgggtcagtgttcccttgtggaagcaccattagtgctatgaatagcaagtggtttttggagccacacggagcatttctggcactgtgactcacatttggagtcccaaacagccaggactcctgttttgctttcctgtgccaccgtatctggatacgccacctgcactgaagttcatcttcctcctcttggggaggaaaactgcagctaaagcacaggactaattgtgtttggggcttggttttacttacgagggtcataaaaacatgctgtgtagccacctccttctcctcatcagggcggtgccagtccacaaattacatcctgacataaccagcatcccaggcaagacatcaagggtaacaagccaccattcccctgccccttcgcctcacccctagctccgtcaggagcaggaaatgagtctgttatctcggaggaggggcagttccaagttgggacctggcccagccagctgcaggggtcaagggtgcagagaggtacccccaaaccttatggtgctgtcctgctgccactgaaacttccacaaatgactcagctagataggagcagcctccttctcaaagccaagggcacagtcccttggagcagcccctgtggaattggaacggatcaccttccaatgcccagagccactgccagcctctatgcaaaggaaagctgcatttcttaagaaagcaatagtgcgggggttggtggtgatgaaaccagccaacggttgaacactagaaacccctctgtagatgtaaatgacatcccaataccattcttatccactaagcgtgtcccccaagatcttattctctaaataccctctggcttggtttgaataactggttttagttcaatgtcagctctgcaacttagtcagcccttctaagtcacacacatgatattatcttacttaataagacccttcttttactcaaggtggaacattttggcttctttagaagttctcgccagggggcctacatcaataattaccgaagtttattctataaaacattagtcctctagaaaaaggggaggggaggggagtcctctagaaaaaggcaagtgaaatggagggtgctatgactctctggacttattagcatattaaaggtactgagaagtcctgcagtcagggaattgatttaaccccaaacttggtggaccccaaaatcctttctcccttcctctctatttgggaaagtctgcaaacaaaattaatttctgaaatgcagccatcctggggcctgttttcttgtgtgggcaattagaattgcagctgtcaccagtcctgctttaacaacttaatcgcttcctctcgctctgcccgcctccctcgcccctccccctccagtggacttggcagtggagtgtgcccatcagggagtgttcttcaaccaaggccagtgttgcacggcagcctccagggtgttcgtggaggagcaggtctactctgagtttgtcaggcggagcgtggagtatgccaagaaacggcccgtgggagaccccttcgatgtcaaaacagaacaggggcctcaggtaatccccctggtgtgtgtgaaaccatggtgcttgtctaggggctgaagcaggcagtcccatggcaaccgcctacagggtccctctccgtgaaaggaatgctgacctgtcctgcccaggaggctttcttttctttagaaactgatcagaaacacaatcctgtcaggtcccgggggctcacgaaagggggcaggacacactgaggcatgggaggagggcgctattcccagggcagaaggccatctgcctgaaccctccactctccaggatgacctccctacagaaaaggggctgtaggctggctgaaggcagcagagtgcaggcagcgtgtggcctggagtctcagtcgcagcccgaggccctcaagcccacgtgggttacaggacaaggtgaaccatcagaaatcaaacaatcccagacggagagagcctggggcaggagaatgtatctccaggcagtaggaacatgtctctggaggatgagtttgggaagccaaggacaggatgaaaatgatcataaccacgagatttaatatcctctttaaaacggcacatcctgtatcactttcttactaattatgaagtgaagcagatggataaatatttaaaagagggcagcctgaccatcccatgcattattgaaatggagctcagcagtcactcactttgcttttagccaaagtcctgccccagccatgaaatttcaagtcacatgtccgtgacttacccacttgtgtctatcccgggaggctgccacttcccctactgtgacagcactgcatgtttacaggggaggctgctgtggatctgagctcagatttggccctgggttttatgaaagtcacaaaaacccttccatgcctcagtttcctcatctggagagtgggagtaatcaatgaatattatgagaatttcatggcacctaggaagtattcaattatgggcaggttttatttttaaacaggaggaagctttaaatgacaggttctccagtctaggtggcagtgagtgtctgtgcatgacatcaggctgtcctgtggggatgccctggctggggaagaagggagggcctcatggaggaaggatgcatttctggccatcagtgcccaccctccactggccccagtccacacactccgacgccacgtgaccctggcagaaagcacttcttgtggctaacattccttctcctcagtcattgcctgcccagcctgtgccccaaacccagcggtcagtgacacaaggttgtctaatggcctcggctggatttcagatctgaacgcaaacatgaccacaagtcattattgaatccgccgtgagttttaaagctaatccacaatcagtgggaaatatgtgaactgatccccatacagaagaaacttttttaccccgtcgttatttgtaagtctctttctgtggctcttttcttggcttatgcctgatgtctgagtcttgacttttgaggccagatacaccgatttcttccaagagaacagatagaggcagaatgggtgctgatttcatcagtgcatttatgccaccgctcaaagtccttctgaaagctcactaaagccgtctaacctcagcatattattttagaatgctgttggggtttctttttcttccaaagtgctttttcatctacggtaataagattttactctgagaggacttacagctgtctaaatagtcctgtctgtctcatgcctgtaaaacagctagctgacctagatccgggtccacggccgggctagcgctcacaggaatgctccaaaatcattcaggtttatttggcaactgagcaacgaggcacataaacattatgcaggccacctggccgggcaggatccggcagcgtcctccgggcagagagccgagcacagccttgagccagtcctgtgggggccgtatttccctgtttctggtgttgtgccctgctgcgtcatctcacttcctggcaggtctctcttcctgtactgtaaggcaccagctgacatttcatggaggattattagatttaaacaatgtgttcctacgggctctccagggagtgtggagtttggatgtgtaggttttccacggggacccagcactgcctgcaggacaaacagggtctgccagatggcatatgcccagcagccagggaggacctgcggttgggcgaagcccctgtgtcccttttggcccctcagggaggggaagagcagctcagcagcatctggaactgttaacctgagacttggttcacccagagagaagttgagagaaccttgagctcttccgggatctgttgcaaagctgtttttgttactttttttgagtggagtacacatacacgggtcaaaccccaaaacgcctaaaaacgtctatagtgaaaggattcccgcccctcccgcccccacctttgtacacctggttcttacccttctccccacggtatccccagttcttagttcctcatgtttccctctagaatgttttcgtgtgcatgcaagcagatgaatgcaagtcctgattgcctttgttatttttacacggaagtttccatgatagtatatcatcttgcactttgtttattgttccctaaaaaaactggaagagctctttataccagtccatgggaacctgcctgattctttttcacatgtgtatggaattctgctggatgaagccaccagaatttcagtaacatcttctgattagcatgcaggtatgtgcagtcacacacaaggcctcagagtatgtgatttcacacacacacaaggaaatccctgggacagctttcccaaagtgggttgctaagtgggaacacatttctaatttccttaagtgttgctgaattaccttccatagaggctgaaccaacgtgtattcctactaacattctagaagtttgtctgtttctttaccctttccaacagaatatggatttttgcccataggagagttaaaaatgctatcttgtttcattttaatatgcatctaccgcttataataagcaaggtagaacatcttattatatatttaaaaaccgtttgtatttcctttattatcaaatgtgctttgcgtatttttcttgcaagctgttaggcatttttcttatcacttctaagacctctttacatacatagtagagagattagctttctatgaatatgacttgttaatattttttccaagtttgttgttttgctctttgttatgataattttgcccccaccccattttttttacatactcaaaattatacatcttttcttttttggcttctgcattttgagtcattagaaggcactccaagtttgcaggataagtctcccacatataaaacttttatggttttgtttttcctggttatatctttgatctatttggagtttggcctggtataaagtgtgaggtatggatctgagttagtatttttaaactgggtttggagtttggcctggtataaggtgtgaggtatggatctgagttagtatttttaaactgggtttggagtttggcctggtataaggtgtgaggtatggatctgagtcagtatttttaaactgggtttggagtttggcctggtataaagtgtgaggtatggatctgagttagtatttttaaactgggtccatatttcatgagatgattggtcaagtggcatgcacggtttatgccctctctcctgctcctccaggacagaccgtcatccaattgcaccactgggtttgcttctttttctgtttatgatcattggaatgaaaccagttttcccatctaaaaatcccagctaaagtaaacctagtaaagctttgtctctcccagccaaagaggagggagaccagccacagatcatgataaaggacaagattcccatagatttcaggaagaaggaccagtggagggggcagaaagagcattttccctcttgagcagtctcccaaaagggtgcgcttttgacaactgctcagtagcgtgttcacaagctgtgggtcaggctggtggcacagggcaaactccagccaaggagacgtctagacaagatagcaaaagggagagtctttctcatgagctgttcccaccaccaaccaaggagcagccctgccaccccacctggaggctcattctgctttgtccccaggggtgttgagtaaggtggttagcttttcttctcgcttctctgcaccatgacaggagaattccagtaactattaccctgattcacggtgccaactgagcagggcacagggttgccaggtgatacatggcacccaggtaaacatgaatttcagataaacagtaaatgcacttttagcttaagtatatcccaaatattgttttgggacatactaaaaaaaattatgtgtcatttttctgaaattcagattcactgggcatcccgtatttttatttgctaaatttggcaacctgagtagaatgtaaagagttgggagaagaaagactgtgaccacttcagacctgtgtcactcatggactaactttgctgcatggaaaagggagatagaagtgtaaatatgtcccaaacctccagaggatgagactagtctatctccccatctctcccctgctccaaagagcccagctctgtgcatcagaggaatatttgcctgcaaggctcattagttacatggatcatggcttgacaagaacatgcagagggaggatggctgatcatgttgaaggccactgaaaacatgagatggcagccactgcccagaaggaagccaggctgtacttcttgtttgtgtcttgcagattgatcaaaagcagttcgacaaaatcttagagctgatcgagagtgggaagaaggaaggggccaagctggaatgcgggggctcagccatggaagacaaggggctcttcatcaaacccactgtcttctcagaagtcacagacaacatgcggattgccaaagaggaggtacaagggggctgtggcaaggctacgacttgcggggcctttcaaacacgagtccttccctagggcccagggatcccagaaatccttgtgatctgagtgtttttttgtttttgttgctgttgttgtcgttgttgttttttctgtgtggtctttcccctctcctttggggtccctagggaagccgttttgtcctgcctctggcgaactccaagcatgatacagcaggtaccttgtttgttctagctagttttcactcatggctcaccctctctgggagcagcaagccctctctgattttctaacacaaccggtccccgagtcagtcatgcagccgcaggtggagaactgttgccacctgtgggttttgccaggaatcagttcaagaacctgtggattcagggcccaaagccgccttcagtgcccctagactgaatttcaagtgttcactcaaggaacatgtcacagctggaatttttattgacattttccaccacggacgtcttgaaaatgagggaaattaaggagactcccccactcccataagagtgtaaatctttctctttcaactccactgttacactagacgggaactggttcccacacagcatttgtaagaggagagctggatcccaggaggttagaccctggaggtggtattttggggcacataaaaggatgagtccctgccaagggctttctggggcaggtatttcagaggcgtcttccttgagattgttatgtgccgtgatggcatgaagctcagctccttaaacatccctgtgacgagaggtcctggggaacccggaaggtattttggcaggccaggcaccatcctgccggcttataattatgtctaatattgaatcaattacaagctcccttcaaaatcacctttaaatgttcaagccttagttcttccatttccttttctttgctgtgtcacaaactgtggtgaatattgtgtcattccttcccctggtagttattatggaaacgttctagggtgtcttccttggtagaaaacacagctccaagaggtaggagcacagtcttacaaagtgcctgcagatatccttcaggacaactccgaaaaaagttacctaaaggttttgtgttctgtgcatctatgggttactccaaggctctctggctgggtttctcggaaaccctgatgacaacaagacatcttaaacacaacatatattttttgttattattttttatttttgtttcatgttaatccttcccttcagtctccaatggcaatgcagctgaagcaatgtttggacgttctttcttctctaatcatcgtttttcaggcatgtgtgtgctctgggcatatgaaaaacatgtaaagagaaggaaatgcttgttcacagcatgcatttccattcagtcatgcctctcattgccattcttgcaattaatcatagattttcgggccagtgcaaccaatactgaagttcaaaagtatcgaagaagtgataaaaagagcgaatagcaccgactatggactcacagcagccgtgttcacaaaaaatctcgacaaagccctgaagttggcttctgccttagagtctggaacggtctggtgagttgactgtgtgtgtatttcagctctcctgagttgcttcttgctaagttcattattcttctattaactgagagtttctcattgtttacattgtatattatataccaagccctgtctcagtgcttccttccatcctcatgaccatcttctgaggtagctgccattatgtctccatttcagagatgagaaaattgaggcacagagagatgaagtgacttgcccagggtcacacagctagcagatggccgagagggctccagtacctgtgcctgtggcccctgtgctgtactgcccctccaactttattttccattctgattctaaaagcagttcatgcccatctgcaaaatgtggatactagtctctgcctcatcagtaattctgcagattatgttttgtgatccccatattaaagattaatgaattgaggctcagagaggttgagcaataagcccagaatcatataaccaggaagcaggagaactttggggtcagttctgtctcatttcaaagctaattcttattcctctacaccctgatttttctttttctttctttctttcttttttttttttttttttttttgagatggagtcttgctctttcccccaggcaggagtgcagtggcacactctcggctcactgcaacctccacctcccaggttcaagcaattctcctgcctcagcctccccagtagctgggactacaggtgcacgccaccacgcccagctaatttttgtatttttagtagagatggggtttcaccatgttggtcaggctagtcttgaactcctgacctcaggtgatccatccatctcagcctcccgaagtgctgggattacaggcataagtcatcatgcctggccctctcttcttttttctccccttatcatttcattcctatcccaatgaaacacactctgtacttgaggatttccaaattttagttgctgatgagaagaatgagaagacaaaagttgagagcaccctgtgttttcatcaaggaagctttggcaaaagactgtttattagacaatgccctgcactgggggctaagtggctgcagtgccaggagccagggggtcttctccagatgactctgagctttcttccattcttttctaggatcaactgctacaacgccctctatgcacaggctccatttggtggctttaaaatgtcaggaaatggcagagaactgtaagtgtttccatcattctgagcctgccgtgggctgaacactagatccactagatttgcaggcagtgacacaggctccaatctgctgacaccccgtcccccccacaccgccgctctgtctgggccagctgtgtccctctagggttggtggggacccatcccttcctctctccagcccacccttcccacttacatcctcagcctgcccccctccaggcctcggcttttgtgtctgcccagcagccatcatgctggggacattcagtggatatttgacaaaagctccctggacggggacacaggcagaactgaaaaagtgtacttttgccagatgtggggtgtcattattcacacaactccccactcacagcagtgaagacaggtaaggctgacccaggtaaggctcctacctgctgggtccttttttctgagcctagtaggggacctcctcccaggaggcatatgacaacacctcctgctgggcctctgcggccctctcagtatatgcaagcctactgcaaatccctccacatgcgtgtgcaaacccactgcaaacccctccatgcgcgtgcaaacccactgcaaaccctccacgcgtgcatgtaaacccactgcaaacccctccgtgcgtgtgcaaacccactgcaaacccctccacatgtgtgtgcaaactcctcagtgtgtgaacccactgcaaactcctccgtgtgtgtaaacccactgcaaaccctccacgtgtgcatgtaaacccactgcaaacccctccgtgtgtgtgcaaacccactgcaaacccctccacatgtgtgtgcaaactcctcagtgtgtgaacccactgcaaactcctccgtgtgtgtaaacccactgcaaaccctccacgtgtgcatgtaaacccactgcaaacccctttgtgtgtgtgcaaacccactggaaacccctccactgtgtgtgcaaacccactgcaaacccctccacatgtgtgtgcaaactcctcagtgtgtgaacccactgcaaaccccagtgtgtgcaaacccactgcaaacccctccacatgtgtgtgcaaactcctccgtgtgtgtaaacccactgcaaaccccttcgtgtgtgtgcaaacccactgcaaacccctccactgtgtgtgcaaacccctccacacttccttttttgtcctgcctgctgggaaaatgagttccctaggtttagattaatgggtggaacttcttgcgtctggcccacacccagagctggctagagcaacccgggagtggagatgtgtggtttccagccggacactgtcttctctccccagctcaggattttattagcctgtgtggacaaacattttgtaggatcagtgttcccaaggaaccatctgtgacaacaccccaggttcctgggacatctctagggacccaaactcttccttttatttcactagtctgtcctatttatatacaaatgtagtcccttgtttgcacttcttccagcgggaacagactcaaacgcttcccctcaccttgggccttggttggggcctttgtgtggctctcttttgagattcttaaagatgctgtgaagggatgggcctggcttccatccccaaacagatgttcttgaccagtctatgtggaattggggtcctgtccccctcccacctcagtcctgctttgtagtccatccctgactctcagcaaatactccaaggcgtctgcacttgtgagtgaagcctgtccattagccttcccccttatccctgtggctggcttcgccttcagcggacatcagtaattgttggccatgaaacccctttgcagaaattgcatttcctccctctagtggcctgtttgcatttgagttctgtgagcccctgcttcatcacttcttacacctgcccctccagggacaggcagccagggctggggtcaccagggtcccctcttgggccctccaacagcaacagtactggcaacagctgggatttgctgagcacagactctgcagcaggctcggttgagctctctatgcctgttccttcataccatcctcacgcccatccatgagatgggtccagctgttttcagatgagaaaatggcacaggaagctggtaagtgacagtcagaaatgaatgctggcagcttagtccttggacccaccgcagtgcaggaccttgctcaacagggatcacccttgtccgccacctgttcatgaggccacccagggtttgcgtggtcatttgtctcctttcatctgctgccttcaaccagctgggtcattagggctggggaacccagaccccacacagtcctcctcccagacgccagacacagcctcacgccacagcaaggactccagtccccgaagcaaatgtccctgggcgtagaagctgcagggcccccaatccctggtgtgtactgctttgcactggtgattcaccctcattgcaaccttccctcttgccaccctaacagtgcttttggctccttaacaccccctcgcctggcacagagcagggcttggtgaggactcactggacacagcccatgtgtcctcctgccagttagcctccatcgggacttttttgaatgtctgttttttaggcccttggcctatattttctcaaggcttttgataaaatatttaaaaataattcacaaggagcctagaaactgcctggaaaaccaatttctgtcttcagttgtctctaattaatgtcttcatgttgcaagaagttccccttttttaatgctggagcatcgtgcgggggattccatggttttccccgtccccggccacctggactgggctggcttctggccgcccacccacgggcccctccgggagctgtttctgtgcgggtctcaggatggagcctgaaattcctcttcctcctgggagcctttcttctgaataaaaatgatatagtaaccaaaaaatctacgcaatagagatatggaaagtcaaggcttccctccctgaccttcagtcccatttgttagaggtaaacgttgttccatcattcatttgctcattcattcttttgttcacttggcaaatacttcttgagcatctttgattcaccaggcatgatgctaggctctgagcatactgcagtgaacaacacagccaccagtccctgtgcctcctgacattctggtgaggtttaacaggagtaaggctgggctcctggatagctttgaactgcaaagtggttgagactggctgagaatccattgaggagatgtcccactgggttgaataagagcagcaagaatttgaaccaggacagcaacttcagaaatgaaagaatgagaggagctctgtattgattcttaaaggaatgctgtaatcctactgcatgtgttagttatgtgttaattcaatctgatttcatcactttgtttgcgtttcttttctttactaacttgataaataattattggctttgaatttttacaatgcaacattgtattctcacttttagagtgtattgtgcattttatttgcatacaatggatttatatatgtgtgttcttttctgttttcaaatgaaatgggagcaagctacatttcgttattgagactgggttttggatatccttccgttctttttattgatgatctcccatgaggaacttttgtgtatttccaaggggttctgctattacaaaccatgctgatgtacttccttgtgcatacaagtggaagtatacacttgtgggagattgttttcagaataaattactaaaattgagtaatctgccacatgaaaaatgggctcaccactgttttggttacatttctttaatcatgatggcattgagcaccattttcacacttattggtaattcatatttctttttctgaaaactaactattcctgtcctttgttgatttttccatttgggtatttgtgtttttcttgttggtttgcaagagctctttgtatattaaggaaaatcacactctgattttcacacagtgttgtaaattttttttctagtttgtcatttgggagtttttaatggagtctctgctctacaaaaatagaatttagcattctgtttatggcttttatgttttgtgttttatttaggaaagattataaaataattcacttattttcatgggttctggaactatttgttttaggaaatgacctaaaaatctcaatggcacctaccattcattttctgcctaacacatagtaggggctctacatgattatctgtaattgttataattacaaggaggtgatggttttcctatttgatagttgatgaagttgaggctcagggaaggcaaagaacttacctaagcaacatagttctaagccagtggttctccaacttgagtatgcatcagaatcacttggaggacttgttaaaatacagatgtcggccgggcgcggtggctcacgcctgtaatcccagcactttgggaggccgaggcgggcggatcacgaggtcaggagatcgagaccatcctggctaacaaggtgaaaccccgtctctactaaaaatacaaaaaattagccgggcgtggcagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaatacagatgtctgggccccaccatagagtttctgattcagtaagtttattagtcttttattgctcctgcaagaagttaccataacatcagtggcttaaataacataaatctattatcttatagttctgtaggataaaaatctgacacaggtctccctgagctaaaatcaagggcttcattcctttttggaggttctcaggagagaatctacttccttgccttttccatcctctagaggctgctcgcattcctaggctggtggccccatcctccatcttcaaagccagcactgctgctctctgaacctgtttctataatctcattttgctctgcctctcttcttctgccagttttggggacccttgtgattacactgggtctgcctggatgatccaggagagtctccctcttttaaagtcaattgattagtaacttgaattccatctgcaacattaattcttcactctgtagcccaacatattcacaggtttgggggatccaattttggatacctggggagatccttattctgcctacgatagtagggctgggggaggcctgagaatctacatttctagcaagttcagaggtgaggctgatgctgctggtctggggaccacactttgagaaccattgatctaagggaggagatgggattctgtcacaggtctttttaactacagagactccagtggccacctctaccttcatctcttcctaaacaagcacacatttttcttcacctgacagcagatcaagcgcttagaaggatttaaatctctccaaagctgcctcttgggtcttggaagggaagctaccctgaagacggcccatggtgccagggaaggatcacctgagccctgcaagatttaaagaaaggaactataccaaggatgtgaacccaaaagctgtggcctccccatgtccactctgtgctaacgtctgcttctctcatgccccctaggctggcctcactgcctgacagctggtccccagctgtgcactctgaggccagcttcaggcccttggtgttcttcccactggtcctctggccacatccccagccaatagctttgggcctctgcctcttctgtctcctcttcaagcagctcccaattgccatctaaaagttatcaacccagtgtaatttctgcccctccctcgttcacagacaccccaccgtccaccaggctctctcgttttgctctctattgccaccccagggaattcacctctttactttttttaaaatccccttcattctctaaagggaaacccttagtcctggccatttcaaaagcatcacacagaagaagaccttgatatttacatttaagtcacatatgcagctactgacacttactagtgctgttatagtcctggctattattccatgaggtcgtcacattttaaccttttgcataagcctccaacggcctgatggaatgatgaagcctcagaacagtttctacacaatggctaagggatgtacccattttgaattttcctcttttctgtgatcacagaggtgaatacgctttggccgaatacacagaagtgaaaactgtcaccatcaaacttggcgacaagaacccctgaaggaaaggcggggctccttcctcaaacatcggacggcggaatgtggcagatgaaatgtgctggaggaaaaaaatgacatttctgaccttcccgggacacattcttctggaggctttacatctactggagttgaatgattgctgttttcctctcactctcctgtttattcaccagactggggatgcctataggttgtctgtgaaatcgcagtcctgcctggggagggagctgttggccatttctgtgtttccctttaaaccagatcctggagacagtgagatactcagggcgttgttaacagggagtggtatttgaagtgtccagcagttgcttgaaatgctttgccgaatctgactccagtaagaatgtgggaaaaccccctgtgtgttctgcaagcagggctcttgcaccagcggtctcctcagggtggacctgcttacagagcaagccacgcctctttccgaggtgaaggtgggaccattccttgggaaaggattcacagtaaggttttttggtttttgttttttgttttcttgtttttaaaaaaaggatttcacagtgagaaagttttggttagtgcataccgtggaagggcgccagggtctttgtggattgcatgttgacattgaccgtgagattcggcttcaaaccaatactgcctttggaatatgacagaatcaatagcccagagagcttagtcaaagacgatatcacggtctaccttaaccaaggcactttcttaagcagaaaatattgttgaggttacctttgctgctaaagatccaatcttctaacgccacaacagcatagcaaatcctaggataattcacctcctcatttgacaaatcagagctgtaattcgctttaacaaattacgcatttctatcacgttcactaacagcttatgataagtctgtgtagtcttccttttctccagttctgttacccaatttagattagtaaagcgtacacaactggaaagactgctgtaataacacagccttgttatttttaagtcctattttgatattaatttctgattagttagtaaataacacctggattctatggaggacctcggtcttcatccaagtggcctgagtatttcactggcaggttgtgaatttttcttttcctctttggggatccaaatgatgatgtgcaatttcatgttttaacttgggaaactgaaagtgttcccatatagcttcaaaaacaaaaacaaatgtgttatccgacggatacttttatggttactaactagtactttcctaattgggaaagtagtgcttaagtttgcaaattaagttggggagggcaataataaaatgagggcccgtaacagaaccagtgtgtgtataacgaaaaccatgtataaaatgggcctatcacccttgtcagagatataaattaccacatttgccttcccttcatcagctaacacttatcacttatactaccaataacttgttaaatcaggatttggcttcatacactgaattttcagtattttatctcaagtagatatagacactaaccttgatagtgatacgttagagggttcctattcttccattgtacgataatgtctttaatatgaaatgctacattatttataattggtagagttattgtatctttttatagttgtaagtacacagaggtggtatatttaaacttctgtaatatactgtatttagaaatggaaatatatatagtgttaggtttcacttcttttaaggtttacccctgtggtgtggtttaaaaatctataggcctgggaattccgatcctagctgcagatcgcatcccacaatgcgagaatgataaaataaaattggatatttgagaa

SEQ ID NO: 426 - DNA, 201923 bp, Homo sapiens
tttttagtttctaaaaatattgttttattaaataactgttaaataggatttttacaaaataaatggcatagaaaagggtaaaaatgtttatgttcccagaactttctatgccttttcaacagaaaggaaaaggcacagaaagttgtcagctgctattacttctggagagctgccacaactggacggtgttggagtatcaccagttctctctctcatgggaaagaaggggatcaacactttgtagagaggtagcacgtcttcaggtaacagctgctacacacagctggcttcaactttagctcccctgttgatgactgtcagcttcaaggtgtagcatcccatggcactcaggaagaattaaggagctgcacgaggttttcaagacatttcaaataataggcatttagagggtttgcttctgagtttgggaaagctgagatagaaaaataagagtacagaaatactagtttatgaaacttggtactatacttaggaggcacacacataaacaaatacatatgaacaggatttatatataatttaaagctctaagttcttgatgtaatagcattccagaatattttgcattttttaaaaaataaacaagttacaaaatcaatatttttttaaattaacagcttacccagagtattttttaaaaagtaccccccataatggataccattaactataattccaaatgaatgccattaatctttttttatgtaccatccttcctaaagcataatctttaacttcactagctccagaaattcatggtcgcagctaaaacaaactaaaacctcccctgcttaaaaaaaaaaatcagactataaaaacacaaataaccaacagatatattacagtacaggaaagacacaattcagtgttttagcataaaaaatgttcagagaataacgctcactgaaatttggtgtcactaaaaatgaataatgtgctttgaaaagaaaaccgtctctagtattgtgaccacatcacagggaaacgtggatataagggtaacaggatcaattcttggaagactgtcctccagctccctgatgttagatccaggttttctgctcacagttaattctaattgggccagttcttatcactaagaacatacttcagcacagtggtcactgttggcaaagaaaatttagtacaaaaataagacgaagatcacagatgcatttttagaagcaatcacatcttaaaccttcatctatctattttattattttaaaaaatgatataattaaagcacatactgaatattggcacattttacaatgccattttgctgtggcctgtccaaatatctcattaatcagaaaatccacttaatagcttctgagtttaactataatctctttcttattgcaacttacttttctttgctaaggagtatgcttcatccactcttctttttactgatgggcttttcaaagctgtttttgcctagaacaatccattaattaggtttcttgccatgtgttatggatcatgatagcaaaacactaattctgcccattgctaactacagtattaaacagaatattatgaaatataataatataactagagagttccatcttagcataatacatcctattgagccaatccccttgcacattctgaagtcttgcccatatcctcttatctaacttgattctttctctattcccattttctttcttcccttctcttttactccttctcccctaatctcaatttgctattttaaactagtcatccttggtttcagtttttcatactccctcaaacctcagatttctgatcacatataccaaatattagcagttggtcaacaaatatttacagagtgactacaaagtgccaaatcctgtgctaagctctggggatacccaggtgagaaagaaaacaacaccctcttgtccttgtgtacgtgactctggccagcagggagaaaactagccccggcagagacagtcagctgagagaacaccattctaggatggctgtctatcctaacactgtcacttggctactacttaatcactagatacttatgggtatttctcttgggaacaacatgtctgcaataaagtggaagtccaaaggccagagaaagagtagaacacaaatctccacgttgcctgcccttttctcagagcaggctttgggctgcagtcgtacaagaactgagctagataaaggggaattgtacaattggataaaacttttgttactcagttttactttaagatgtgttttcccttgatacgtcttttagaagaaacaatctatactaaaattgcaataataaagtaaatcaatttaaattaagaggaaaaagtcagttcagagattctcttctaaactgagacattctgttgaaatgattaaataaaaagatttcaactgatggtttactaattgtatgaatcagcaaagggaacatggatctttgattttgtcttttttcttttgctgtaactcttgacacctttggatgtatcctaagagtttatacctgggttataccttgttgtttgctccccaggtgtaacaatgatttttaaaactgaccttctgataattgtaaatcagagcccaaagggcagctgctccaatcctctgagcattttgattctcactttccagacaggcagcaagcacagtaatgactttttctaaaaatgaacatatattttttaaaagttcagtcccagacactgcattgtattcttatcttggactagtcagacacccccctcttttcccattagaatgcatacataaagttggtatcactagactatggcaaaaccaatcttttatgccatgtggtatatgggaggacaacctcaaaacattgttttcatgtcaggcatagaagggtcaaagacactgaagctgcttcattttttggccagaattcaagaaaaggcacattcatttaaagaccacaagtgtgtaaaaataagtatacaattaggtacattaatgagttactcaattacagctaacattctggcaggcagaaaaacagatctgctttcatgataaattataaagactatcatacaaacacatcagtagcatgagctactatacaaaaacgatcatcaaatatcacactgcttgatgttttttaaaaatgactagggtggctggcaagatggctcaataggaagctccggtctgcagcttccagtgagatcaatgcagaaggcgggtgatttctgcatttccaactgaggtacccagctcatctcactggagctggttagacaacgggtgcagcccatggagggcgagccaaagcagggtggggtgtcgcctcacccaggaatcacaaggggtgggggagctccctcccttagccaagggaagctctgagaaactgtgccctgaggaacggtgcattccggcccagatactacgcttttcccatggtctttgcaacccacagaccaggagattcccttgggtgcctacaccaccagggcccagggtttcaagcacaaagctgggcagccatttgggcagtcaccgagccagctgcaggagatttttcatacctcagtagtgcctggaatgccagtgagacagagttgttcagtcccctggaaagggggctgaagccagggtgccaagtggcctagctcaacagatcccatacccatggagcccagcaaactaagatccactggcttaaaattctcactgcctgcacagcagtctgaagtcgacctgggatgctcgagcttggtggggagaggggtgtccaccattaatgaggcttaagtagcctgtttcccttcacagtgcaaacgaaggcactgggaagttcaaactgggcagagcccaccacagctcagcaaagacgttgtacccaaactgcctctctagattcctcctctctgggcaggccatctctgaaagaaaggcagcaggcccagtcaggggcttatagataaaactcccatctccctgggacagagcacctgggggaaagggcggctgtgggtgcagcttcagcagacttaaatgttcctgcctgctgtctctgaagagagcagtggacctcccagcacagtgctcgagctctgctaacggacagactgcctcctcaagtgggtccctgacgctcgtgcctcctgactgggagacacctcccaacaggtgttgacagacacatcatacaggagagctctagctggcatctggggggtgccctctgggatgaagcttccagaggaaggagcaggcagcaatctttgctcttctgtagcctctgctggtgatacccaggcaaacaggggcaggagtggacctccagccaactcccaaagacctgcagcagagaggcccgttaggaagaaaactaacaaacagaaaggaatagcatcaacatcaaccaaaaggacatccacacaaaaaccccatccaatggtcaccaacatcaaaaaccaaaggtagataaatccacgaaaatgaggaaaacccagtgcaaaaaggatgaaaattcccaaaaccagaataactcttctcttccaaaggatcacaactcctcaccagcaagggaacaaaattggatggagaatgagtttgacgaagtgacagaagcaggcttcagaaggtgggtaataacaaactcctccaagctaaagaagcatgttctaacccaatgcaaggaagctaagaaccttgataaaaggttacaggaaatgctaactagaataaccagtttaaagaagaacataaatgacctgatgggagctgaaaaacatagcatgagaacttcgtgaagcatacacaagtatcaatagcgaaatcgatcaagcagaagaaaggatgtcagagattgaagatcaacttaacgaaataaagcgtgaagacaagattagagaaaaaaaaaaaagaaaaggaatgaacaaagcatccaagaaatatgggactgtgtgaaaagaagcaacctatgtttgactggtgtacctgagagtgatggggaaaaatggaaccaagttggaaaatactcttcaggatattaaatgcaagagaacttccccaacctagcaagacaggccaacattcaaattcaggaaatacagagaacaccacaaagatactcctcgagaagagcaaccccaagacacataatcatcagattcaccaaggttgaaatgaaggaaaaaatgttaagggcagccagagagaaaggtcgggttacccaccaagggaagcccatcaggctaacagcagatctctctgcagaaatcctataagccaaaagagactgggggccaatattcaacattcttaaagaatttatcttttctttttttgttggggagggggatgcagtcttgctctgtctcccaggtttggagtgcagtggtgagatctcggctcactgcaacctccgcctaccaggtttaagcaattcttctgtctcggcctcctgagtagctgggacgacaggtgggcaccaccacacctggctaatttttttgtatttttattagagacggggttttaccatatgggccaggctggtctcagactctggatctcatggtccgcccaccttggcctcccaaaaggctgggattacaggtgagagccactgcgtatggcccaagaaaataattttcaacccagaaattcatatccagccatactaagcttcataagtgaaaaataaataaaatcctttacagaaaagcaaatgctgagagattttgtcaccagcagccctaccttacaagagctcctgaaggaagcactaaatatggaaaggaaaaacctgtaccagccactgcaaaaacatatcaaattgtaaagaacattgacactatgaagaaactgcatcaactaatgggcaaaacaaccagctagcatcataatgacaggatcaaattcacatgtaacaatattaaccttaaatgtaaacgggctaaatgccacaattaaaagacacagactggcaaattggatgaagcgtcaagacccatcggtgtgctgtattcaggagacccatctcgtgcaaagacacacataggctcaaaataaagggatggaggaagatttactaagcaaatggcaagcaggggagaaaaaaaaagcagaggtggcaatcttagcctctgataaaaaagactttaaaccaacaaagatcaaaaaagaaaaagaagggcattacataatgataaagggatcaatgcaacaaatagaactaactatcctaaatatatatgcacccaatacaggagcacccagattcataaagcaagttcttagagacctacaaagagacttagactcgcacacaataatcatgggagacttcaacaccccactgtcaatattagacacatcaacaagacagaaaattaacaaggatattcaggacttgaactcaactctgagccaagtggacctaacagacatctacagaacactccaccccaaatcaacagagtatacattcttctcagcaccacatcgcacttattctaaaactgaccacatacttggaagtaaaacactcctcagcaaatgccaaagacctgaaatcataacaaacagtctctcacagcacaatgcaatcaaattagaactcaggattaagaaactcactcaaaaccacacaactacatggaaactgaacaacttgctcctgaatgactactgagtaaataacacaattaaggcagaaataaattagttctttgaaaccaaagagagcaaagacacaatataccagaatctctgggacacagctaaagcagtgtttagagggaaatttatagcacaaaatgctcacaggtgaaagggggaaagatctaaaatcaacaccctaacatcacaattaaaagaactagagaagcaacagcaaacaaattcaaaagcttacagaagacaagaaataactaagatcagagcagaactgaaggagagagagacacgaaaaacccttcaaaaaatcaatgaatcccggagctggtttttggaaaagattaacaaaatagatagaccactagcctgactaataaagaagaaaagagagaagaatcaaatagacacaataaaaaatgataaaggggagatcagcactgatcccacagaaatccaaactaccatcagagaatattataaacacctctatgcaaataaactagaaaatctagaagaaatggatgaattcctggacacatacaccctcccaagactaaactaggaagaagtcgaatccctgaatagatcaataacaagttctgaaattgaggcagtaattaatagcctaccaaccaaaaaaagcccgggaccagatgaattcacagccgaattctaccaggcatacaaagtggagctggtaccattccttctgaaactattccaatcaatagaaaaagagggaatcctctctaactcattttatgaggccagcatcatcctgatacaaaaacctggcagagacacacacaaaaaaaggaaatttcaggccaatatccccgatgaacatcgatgcaaaaatcctcaataaaatactggcaaactgaatccagcagcacgtcaaaaagcttattcaccaagatcaagtccgtttcatccctgggatgcaaggctggttcaacatacacaaatcaataaaagtaatctatcacataaacagagccaacgacaaaaaccacatgattatctcaacagatgcagaaaggccttcaaaaaaattcaacaccctttcatgctaaaaactctcaataaactaggtattgatgcaacatatctcaaaataataagagctatttatgacaaacccacagccaatatcacactgaatgggcaaaagctggaaacattccctttgaaaactggcacaagacaaggatgccatttcttaccactcctgttcaacacagtattggaacttctggccagggcaatcaggcaagataaataaataagggtactaaaataggaaaaggttcaaggcagggtctgtgagtgtagcatctgctcactggtactggttagagggcagtgtctgctcactggtattggttagagggcagcgtctgctcactggtgttagatagagggtagcgtctgctcctggtattggttagaaggcagcgtctgctcactggtattggttacagggcagcgtctgctcactggtattggttagagggcagcgtctgctcactggtattggttacagggcagcgtctgctcactggtattggttacagggcagcgtctgctcactggtattggttacagggcagcatctgctcactggtattggttacagggcagcgtctgctcactggtgttagacagagggcagcgtctgctcactggtattggttagagggcagggtctgctcactggtattggttagagggcagcatctgctcactggtattagttacagcacagtgtctgttcactggtactggttagagggcagcatctgctcactggtattagttacagggcagcgtctgctcactggtactggttagaaggcagtgtctgctcactggtattggttagagggcagcgtctgctcactggtgttagatagagggcagcgtctgctcctggtattggttagagggcagcgtctgctcactggtattggttacagggcagcatctgctcactggtattggttacagggcagtgtctgctcactggtattggttacagggcagcgtctgctcactggtgttagatagagggcagcgtctgctcactggtattggttagagggcagcgtctgctcactggtattggttagagggcagcatctgctcactggtattagttacagcacagtgtctgctcactggtactggttagagggcagcgtctgctcactggtattagttacagggcagcgtctgctcactggtactggttagaaggcagtgtctgctcactggtattagttacagggcaacgtctgctcactggtattagttagatggcagtgtctactcactggtattagaccaaccacaatgctagtgtattttaggagctcaataaatattcgttgtgtgaaagattccagaatagaataaacaaaaattttgtctacataattcaatttttttattttaagggattttaaatatttaacaaaaacaaaacaaaaaaagctgctccctaaagtgaactggaaatgtgcatcaggacaatgtgaaaggcaggtgcagtgatgtttcgggcacgctgcagccgactccctgaacacctcatctgcactatctgatgccctttggttgtcgtgtatcataacctacccagaaccaagccatgtacatagcttgcagatgcaatttatcacgtgaggttatggctgcaagtgctactcattagggcacatcaaatgtccccttattaaatgggagggtgacttccttatgttccatctgagtagcatcaagtgatgtttttaaatgttgtctcaaacactcagaatatataactcctctgatctaagtaagtttataactccttcaaccagctatcccttaaagcatttttaataaagtactgtgtgtgtatgtatatatacatatgtgtgtgtgtgtgtgtgtctgtgtgtgtgtgtgtgtgtgtgaattaatgtggtgggcccctctgataatgcaagtggatcgacttttttaacaaaacaaatgttattgtgaaacatgcatataacaaagcaataaaacaattttgagttcaacaagtaggtctgaactctcatataaacatttaaataacctaaagtgaatatacagtagtaaaatgtaaataatgagacagtatttttgaatatttgaactgaatattaccttaatataataattgaatgttaccttaatataataattgaatattaccttcttaatacaattggtttaagtataagtttagggatgtcagtttggtaattacagtgagttgtcagttatggtgacattaatgtcttagaaaagttcttaaagtttttacccatcatttcttcaaatatttcctctcccattctcctaggacacttcattaaacacaaagactgtcttgatatatctgctgtgtcacttacctttgattcttttgatcctttctcatctttttagctttctctgctgcattctggataatatttttctaatctatcttctaattcctaagttctctgctatacctaacttgctgtcagacatgtatattaagttttcaattttggccactgaagttctagattactgttgtaaaacagaacttcctacaataatggaaatatttatatcttgctatttaataagatagccactagccacatgtagtgagtacaactgaataattttaattagtttaaatttaaatagctacatgtggctgattatcatactgcacagtaaagttcttgaagttctgtttggttcttttcaaatatttcaacttgtcagtttcccatttcctaaaattttcaagcttgtcatttatttatctaaatatggtataattaaagttatttttaaacccatgctttgtaattcccatattcaaagtctgggcagataagctggtatttttattcttctgctgtttcttactacatgttgccatgtctcctaatgtgcttgattatctctaactttgtactggttaatgcttttgaaaaattatttgtagaggttccctgaggcccagtatgaacttgtctttcatccatcaccaaggcagtttgctttctgctaagtacccacaggcaccatcaatcgaagacacctcaagccaagttcacggccaactttgggtgcagagccctatcagaagcagtctgtagtacccattctcacattttttttttccttttctttacagtctccttcatgaagtttgggaaaccaacttatttttgacccatccatctattaagagaatggttctttggaggtccagcttaatacaagcaggatagccagtaagaatccccactttggggaatcgcggcttctgtcctctcacccctcgatactcctcaacaaaagccaagcatacaaccttggcaaatgcacttggggcaaaataattttctatatacttcttacttgtctgggcaagactttcaatcaaaactggactgggagtttctatcttttcagtttttgtgattattttgaggtgcattttaatacagcctgtctagcatgttattgtcgttttcagaagagacttagtctggcattgccagaaacaaggaatgttccagatctttttttttttttggagatgaagtctcactctgttgcccaggctggagtgcagtggcgcgatcttggctcactgcaacctccgtctccccagttcaagcaattctactactggggactacaaggtgcccgccaccatgcctggctaatttttgtatttttagtagaggcggggtttcaccatgttggccagactgatctcaaactcttgacctcaaatgatccacccaccacggtctcccaaagtactgggattacagttgtgagccaccatgccaagccccagatctatttttaccagcaaggtcaagctccactgcacactccactcctgaccatttaaaccagatgtgtgggtgctaccgatcagaggcagcctttcctgggagacttttaagctggctgactctgctaaggcctcctccataaatccccaagtggaaagcgaggcataggctgtgacatccctttatagttccacacagaaactgcacagctgatgtctcttatcttacccctgcctgaaaagcccactgatctctagtctgtgggctaggggaagcttctcaccaaagtttatccatctgctttaagctaatgaaggagaaaaagcattgctgactacaaagaaatgctaaaaataattctagaggggtctagaagtggaaaatgcagacttctctccttcacttctcaaaaagcttgacctttttccaactctcaataataaactggagtaagtagccctcaaagaaaaaaaaaatcattctaagaaaggtgaataaacaataacagatgttactgagtagctgctatataccaagaatggtcacaaacacttcacaggctctctcattgccctgaggagggattatcatcaccctcattttacaaatgtgagggctgaagcagctacagtgggagaggatggaaataaaaccagtgatgtacatcacgcagcaacagagaacgcagcatcagcacagcagccaccggaaggcagagtgcaaaatccacagtaaggttaggtctgctacaagctaactgaactttaaacatccttctatatcatatctagcagttgattatcagaatgcttatcagaaaaatagaatcacaactatatacaccacaaaatataagaagaatcattttcgtacacttagaaaacccttgatttcacagaaaaatgcttctgagaaaagtttaagtgaaaaacatgaaaaaaacaagagaatgaatctatcttaaacatttatcatgtaccagaaatagcgctaggcactttatgtgtgtttataaactgattcttaccaaaccaagaagagtgggcttcttttatagatgaagaagctgggcccagcgaggctgcaccaggcgacgctggagtgatgccctagtgctggcattcaagaccaggtgtgtaggggtctggagcccaccttctgtttttcactagaacacatgtcttttataaaactcactccccacgaaattcacatactcctcacagagataacacatggttgcagaaaaagatctttccgattctttttgcttcaatttttttctgaatccttaccaatcctcgcctccatctgtcctacatctcagagaatgaagtctctgcgaggctcactgcaccatctgatctcaagccctgaactctctccggtctgcttgggatctctctcaatcatcaaatatttattgagtgctcgctagttgcaggcacaattctaggtgctacacataaacaaagcagacaaaagcctcctgaccccataagagcttaccttctagtgtgggaagactaggaatagacagatacatgaaacacataatctatcagatggcgataatactacggagggaaacaaaaccaggaaaggaaatagtgaggaggaggaaagagaaggccccctgggtgcggggctattatattaacacatggttcccgagaggcttcattgacatagtagcatttgcttgaagatgcagaagaggggagctggagttagaggaagagcaaggagagaggagagggagcagaaggtaaggccagggagccctcgtccacggctccccttcctccaggtgtccagtatgtgcactggaatgacatgatttgctaacctcaggagactcctggaagcccacggaaggctgaagccatgcctgattcattcccatgccttccacagtgctttgaacacagtgggtgcttaataaatgcctagaaaattatttataaaattatttggtgttgacctgaacagtctatgaataactacatatataaatgtatgtgtgtgtgaaaacttaccattagccaggatcttgggtttatttgcaggactgaagcaaacattatgaaagataagaagaggcaataaagggctgctcttgtgcttgtatttgctcatctctgttagtaagtctagacagccatcaagcctcagaatcatttgttgcccatcttctccagatgatatattcaggagtaacttcaaccaaagaatagtcagattacttagatgtttatttcctccttttggcaatgctagagagaggaagttctgtaagaagttactctgtggataaatagagagaatattattttcttctcatctttttcattattttcctagtcccttggtgaccaattaactaacattctgatatactctccctctacattaatttctcctttctaatagcttctgaatattccatctatattatttccaagcataagtgaaaaaggtaagaagaacaaaatagtgctcaagttttaattcctgctaattatttcctcatgatggatgaagtatactatagttaactcttaattatttagaattggtaattaagtttggagattatttcagggctcttgagttttctcttctctctgccttctggtgattttgctattaaaagctaccctatggaaggaaaaaaggcaaaaatccaaatcagtcttgaatactagttaacaactctggaagtagtgagggtattttgaatcattatagctacaggtgttgttgttgtttttatcaaatctatagatacatcttacattcactttatcccaggtacttatcattacaagtaagaatttctgatggctacacgtcattctattatgcttacagatgagaaagctctattatttgaactgtaagagtcttttcaacctccaaataaagccccttccaaaaaaccccaccaaacccttcactataagaaagataataaattattgcttagactaatctatatgcaaagtataaaagtgctgcatcaagctgcagcccatggcagcatggaaaccacagttaggtggacattttagaaatgaaatgcaatcacttaacttttatgattgcacagaataactcttctctctctctgtttaaatctactccagtttatctcttaggttttcctagaccaaaatcaagatgttggctttaatctataaaataaacttaacgtttttatacaaaaggactctgagtgttaagaatgaaatgagctacagaaatattatcaacattacccacacaataagtaaactgtaaaattacatgcccactttcagctgcatgtgctgtcactcacacctactgtcagccaaactgacagtttttagattcaacccttgctggatttgggactgacaagggtgataaagcagatgtcagtgctctcaaatataaatgtgctgtgggcactccttttttttttttttttttttttttttgctgcttctaaagatgttttcagacaatttcctacaccaggtagaatatgtagagatgtataccatggtagaaaaaaaaacaaacaagcaggatatttcggagcctgagttgtacaataccacctgctgcattttctatgtcctacagatgagtaatgaagaagtagaagtgttaagtgtctgggctcattattacttaatgcagcagaggaagtctcaggcatttcctaattagagcagaggaaaaagacttgattaatccgtccctggaaagagagtctgatcacacttcatcaaaatattcttaagtatagcaccagaataacagattaagagttgaacatatcttagagattattttgttaaacccaaatgaagctgaaagagaataggtctccagctcaaagtcacagaccagactcgagattggcacttacattccttctgggtgctcccacttagcttcccaccaacatgctctataaggaagtggtggaaagcactgcccccgctctgctctcacatatgcagaatctctcattcttatggatgctaatcacatatatccagttcaagagaatgtctcattttggaagtgatgcatgtatatgaatacatatatgaagaaaatatattcaaatatatatacatatatgacatacatgaacatatacatgaagaaaatatccagccatgtgctggtaaataaacaactgattgtggtgagggtagaaaagatccaagatttgtacagttcgctgaattacgtggtgtgatatgcccactgtggctgatttcaaaataacaatgtaacatcaactggaatttttataaaattcctgcaaatttaagatgacactcatgagtcagtaggaggctggctccaacgtgccactgaaaacatctttccttggtaagattgatctttccatttccttagaaagaccgaactttctatttatgtggtgataacaaagtatcttctgaggagttcagggagaagaaacagtagaggaaaaggagactcaattcttataaatgctctcaacttctgcaatttatcttggccttcaagtaaaagaaatggaaacactcaaattacaatactagtaagtagtatataatctgattacattcaaatttgaagggattttcccaattagggattctgtttatacacatctaaatacagaatataagtgcacatgtgtactagaatttatttaactcattacatcccttttaaattaccttaagttaaaatcagtgatgagaagtctagattgggaactggaatcctagagaactcataaaattgcttaacatgccataaggaagttaagtctaactgggggaagtgggctgtgatttcataaaccattttgtcaatgaaattaaactgaaattgttactgcccaatttggtctgtttaaagaccaatatattacttttattatttccaataaatgtaagacggctatctttctaaaaccctcatctttgagaatgataaaatacaatccgaaagctaagaagataaatgagaaggaaatggtatgactctactctagctcctgtccttctgcacgtgtcatctatcaactggctttaaacaaagtgaacctcttaacccttttataatcctttaaaataaaatgcctcaaaatcataataatcttagaaattgagttgtaaacttttgattggaaagattatttcactgagtacccttttaagatatgtggggagtttaagtgcgtaccttctgaattactcctttacagtcatgcgacaaggccaggtttgaaagaagcataaaaaccatctgctgaaccgtggtgttctccagtggcatctgggaagccaactttaggatacacagcatcagagagttgctcacggctcctctatgtgtagcttgaacagggtgttgtccacaacttgaccaacaaagagaactgcaaccttcaaaaataacagcctatcacaatgtcttctcagtttccctgtttagtttttgaagacactaagtggcaaagcatatctgtctaacaaaatgactaggccattaacctgtgaactgcaaattagcaatggaggctaatgttggtgtctacagtcaacctaatagatatactgtcctcactgagggcctaattatctcactaaagcactttaagacaccaggtttatttttaaaaaaagaataaaataaacatactagggtttttaatagttgctaaagaaaacatctaaataaaggcctgtgtaaaggaacagaattttagaaatgggagataacttgtctaatgccttcattttacataacatacaaataaggaacataatatccctgggaaagcggacaaaacaaatactattttctatatttggtcaacaaagatatggagctcagaaaagccagtttgttgttcaaggtcatacagcttagcatagcaggagccaaaagtggcatctacaggctttccagggttcagtgtttctcaggaaattaagtaactgaatgagacttattgagggagaaaaaaaaattagaaatatattttaatgttaaatcaataagactgtattatacataaacctaaggtataattgacttgtgaaagttcatacgaggaggccaacttaagtataaactgatcagaatcaaatacattctgtaaaagaaactcataaaagatgagtaaacaaacaaaagatatactagtggagctggaaaatgcactgaaaggagacattcccaccagacctaaggaatggagaaagttaacagcacagaatgaaggcaaggacaatcctgtacacatatgcttcaatgacagttcaagttcaagagcttgaaggtctgtttatatctctttgtgctgactggagacaacctgagttgggtatcgaaatggacagctccagaggtgtcagattattcaaaggaataagccatcatcagcatctggcagattattcaaaggaataagccatcaacagcatctggcagtaactagatgggctccttaactgttgtgagttccagtcccttctctgtataacctttgatattcagagaccccagttgctgggctactgagtgttgttagaagaaagtacaaaaacttgctagtcaaatcttaaatttatgaccataaatttaataaaatttaaatcttaaatttatgaccataaattatgaccataaattctaatttattttcttaaatttatgaccataagtggtacttaacactgccagcaatcctactttgcttctctggtgtgtttactttccttcctctaaaaacagctacttcacactttctcctcttctcacatcacctctactccttgtctttgctcattcttagtggtcagtgttctctcctaaatgaagaaagcagaagtattcaaaatgggaattttctcatcattcccatcaagtctaccagccctcctaaatccacatccttcctctcagccttccctccgcttctgttgtcagctgtgctctagctctcacctctcttaccctctcaggctgggctcttacctgcactctttcctgcacctcattctcccaatcccttaagttaataaacatgccttaaaaacatacatctttaaaaacgagcaaaaactcctcctttgactccacatctgtctcttgctgttgctccatttctttgtcctcttaagagtagtacattttggaaaagctgtctcctctacttcttcatcttctctcctcagctcacactaagtaggtttctgttctggcactgcactaaaattaccctcaaggtccaaaagaacatcaatactgctaagtccaacagccattttttctatcctcactttagcagaattttcaatagcattccacacaactgagcatgcccttctctgactttctgtgactgtgcactgttatctcattggctgctccttctcttttttttctgctggtttctcatcttttgattaactccaaatgttgatgtgcctcagaacttggtcatgggtttctgcttctccatctacacattctccctgggtaatcgcaaacagccacgtggctttaagtacaatctacatgacaatgactcctgtggtagccagcctccaagatggtcccagtggcgcctgcctctgtaccagggttggtatgtgtgacccacaagagctaggagtgctgttcagttacttctgagactggattataagagactataacttctgccctcagcccactcattctgggtcgtttgagacagccctaagtagcaaggaattgaggctcccatagtcacactggatcctctatcccagtcaagacttcagatgattgcagagactctgagcgaggaccacccagattagccacgcccagattcctgagccacagaagccgtggcataatgaaatgattaatgtttgcagatgctaaattttagagtaatttcttttgtagcaataaataactaataatattcccaacatttgaaatcttcaaacttatctctacactccattgaattcaactccagcttactattttcacttgagtgaacatcaacaccttagacttaacaagaccaaacagaactcttgattcctactactttctcacttcaagtctgcttcttttaaatcttccccattttagtaaatggcactactgtgcactcaggctcatttctccaaatgaagttcaccccggacacctttttttccttcctacctcccacaacaggtatccttgactctacctttgagctatatactgaatctgtctacttctctcaatctctccagctaccactcaagcccaagccaccattatatctccatgacaagtctccctgcttctagacttgctcccaatcattcattctccacataccacccagggcaatttttcttttcttttctttgtgagacagagtctcactctgttgcccaggctggagtatagtggcgtgatctcggctcactgtaacctccgcttcctgggttcaagtgattctcctgcttcagcctcctgagtagctggaactacaggcatgcaccatcatgcctggctaatttttgtgtttttagtagagacagggtttcctcatgtttgccaggctagtctcaaactccagacttcaagtgatccgcctgcctgggtctcccaaagtgctggcattacaggcatgagccactgcacccagcctaatccttcttaaacacaaattaaatcatgccactcaccagcttacaactgccaatgtcatcctgttacactcacataaaaatccaaactccctactctggcctctgaggccctacatgacctgtcctcctatctcatttcagatcactctcaccagaactcacaatgcatggcccaccacaggctcttgataaagtgtctatcaagtgcatgagcgaaagaggagccctagtgatatcaagtatcaccagaccaactgttatgagaactttcaacatgccagtctcctgctctagaatctatgagaagttctaaccttcacgtggcttttgaggtcttacatcataatttttatcctctcaattttcctactaaactcaatttcccattgccagataatcagaccagtcctccctctctattccctgcgctgccaatgactctctcatgtcaacaaacacactaaaatatctgtctgctctcataatacctacgagaaagcttgcctttgcccatcatatcctcaataaatcagagaaatacttcaaaatatgtattagtttttccagtccaccttaacaacatttataaaactagtattttggtatattattgaaaggcagtattggatcctattaccatttggaaaatttgcagtatagacacaaaggagctgcagagaaatttgcatcaatgaatcatccatcaaaatccaaggccagagagagtgcaagacagggacaaggtgagcttcaagagctgcttcctgttgaaggaagggaaaaagacagcattagtctgaatatatgaaaatataacattaaaatcaaaacaacaacagaaagccatcaacataagacccaaggagaaccctgtggatggcttcagcatcctgccccagccccattgggctccacacatggctgccctgaccacgagcctgaccaatctcaggacgtcgcttcaacaccagggtggttaagatgtaccactaagttaggaagcatagaaaatagcctgtgtaacatgtaaattaaacagcaaagtgatatctcacaacactgaataaattcctgtaaatgctatgaactggccaagaagtgagaatttctggttaagtaaacattctgatcaactctgagtcctctttgcccaccctctctccctctccttctctctctctgtgtatgtgtgtatatactcaaagtaaattacagtttttgagtaatttgaatatataaaattcagtctaaatattatgataaattgaaaaattctgaagtaactcagagtctttattacaaagatcagttaccctgggacaatattgcagataaaatatagctgtttaagtgcagcaatatctattttaaatgaacaagaattccgaggtaatttgtagacccatgattatgcacgtgagcatgcacataaatacacacaccctatacgatttcacatagcatcaagtggcagaagagaagtgattcccaatgttcaacactctccgtaagcactgaagtcattcccagtgctctccctaaagttcttcccttgttcaccactctctgtggcacacggccctccatctgcagcagatgaccttgtttactatttcacagagaagacagaaacgattaagtacaaactcctttatctactctgccattctgtccacatagtttatctgtattttcatccattcatccttcctgtctgcccggtagtgacaaagaggtgttccacttcttgcctgccagagattgatacatccatctgtgttctgaaacacagctcttcctgcctcctcagggatcttaatccaccagttagttctcctcttgctatctcttaaacaactcgtccccaatttgctcatttctgtgcctgtattcaagtagtttacgtgttaagagaaacaaacatactcatttcctttcatcttatatgtcctaaattattaatgccactattcatgaccaaacttctacattattattgctgtaatttccctgcctcacatttaatctttagctcattaccgtttattttctgccctgatgattctattgaggccgcttctacttttgtggttgccaacaacgcttaagcacggtggcatttgctatatgtctcttaatttccccgctgctgctctatcctggatcatttctgataagagtctggatatttgtccctgcccaaatctcatgttgaattgtaatccccagtgctagaggtgaggcctggtgggaggtgtttatatcttgggggcggattcctcatggcttggtgctttcctcaagacagtgagtgatctcatgagatctggtcatttaaaagtgtgtggtacctcctcgccagctctctcactcttgctccagttctagtaatgtgatgtgcctgttccccttttgccttcttgtcatgattggaagtttcctgaggcctccccagaagcagacgccactgtgcttcctctataccctgcagaactgtgagccaattaaacctcttttctttaataaattacctagtctcagatatttcttcatagcaaggcaagaacggcctaatgcaatctccaaattccttctccagtattcccttctcagttgttttctgccccctcttaaatgttcctgttttccaaagatatgaccttggttttcattacatactttcttgggaaatttcaacaatagtgaggaccacaaacaccatctacacattgataactcctaatatccccagcttgtatcactccttagagtcccagacccataaaatctacaggccacaagccatttttcacctggatgccccaaagactcttgaggctagcacgtgcaagcatgaatatcgggtctctcacacctgtgctctgctctatcatgcactcttaatgcatgataatgcagtggcttaaactggagtttggaagtcattctacattcctcctcttctcaatgcctcaaatttactccctaccctccttctcctttctacctgctcaagttaaggtgtcatcatctcttgtctggactatgacagtcccctccgtctaaccttgtccactgtttaattcatttacctcacagccaccatgctccttccagtatgaaaacccctaatgttatgcatatgcaaacagcagggtggggtggcagtgggtgacctggtgaattacccaatagtggccaactattaataatgagaacatgccatacacctgataaaagctgaaattgaaattaacaatccctacctccataatattatatttatactcaaggataatcttaatattctttggatttacttcttattaaacaacttagaaatacagaaatgctttgacttattgagatatcacacttttgtaaatggctaatgtgatacaaattgagcacaatatttataactagtagccaggttagcacttcataaatctttataggtagatcccacatgtaaagtattccagagtatttccctgaataaggtgtcatgaatgaatattaactgcacatacacatgaaatttatatatttaaatttacacacaaatactgactgtacatccagtcacaagcataatatcataagcatgaaggaatcattaagtttattaatggcacttttgtcttgagaaaaagttcatataaattcatatatagggaattttaataaattgtataaataaatacttaatttccatcaaactactttgaaatataaattgtgagtcatgtatctggctttttaacatcgcttaaggagtaagtgtgttcaacatgtccattttccagatgtggtatggtttttccagttgtgctcttaccacaagtaagagcaaaacaggtaaaaatttataaggcaataaaagcttccataatttatctttgctttctatattaaagctttaatttagtattttttaaaatttttattttcgtggccagcttttataaagaataatctagtatttctgcattaaagcatcaatctagtatttcaaaagtgttgtaaaactatagacaaagcaaatcagagtgttcacaagattatatcctctatagtagtactgatacaatggtttaaaacatcatcagtgcttacagacgaagcaaaacatctcagtgatttttagacagaagggccatgtaaatggtcacagggagtcagcagagctagaagaaacttcctctcggtggatgtggccacactaggtagcagctctaactatcttctcctttgaagcaggaaactcttcattttctttccttatagatacagatagcttcacttatttccttgaagagttgttttgacaacccgttttgaaagaatctaccttataaaacacatccagccattcattccatatgtaaaacatttaaaatacctaagagtacagaatgaggctgaagtttgcgaagaaatgtaatcagtgtcgatgaataatgattagatacacacatttctgacaattaacactgagtttaaggaccaatcaactgtgtgtctaaaaatttaaaagtcagagctttccatttttcctactacattatctcacataaaaattaaactgcttaataccagtactcctattaaaattttgaaaagtagttctacttactttacattcctcattttgataaagacagtttcttaggagctgcatggcaatgcttaactctttaataacaccatcctcctatttaaacaaaaagcagttgaaaactgtgaatgcaacagcatacttcactttttgtgtatagtaattccctcccctttgggtcacgggacaatgcaggtgtgctctaatcatgcccaaccactgtaactttgagggaactgacaggctaacgatctctgaaagatgaccatatctcaagaagcacattcaccatgaaaaagctatttctgttctatcaagcatggaggaactcggatatatgatagcctccatgtttcatctcaataaagtgaggcagatactgagagattttcaataatatcaggtgttggctgactttctcaatgatgaagggcctttggctagggaggaaaagaggcaaaaaaaaaaaaaaaaagaactgataaacatacaatcaatctcctgcatcaattacattattaaataagactttgtcttggtttcttaaatgcagtagaaactagttattacatagagtgctgctataacggccttacctacacacatatatgtatatttatatatttatactattcacacactttcatttgttgaataagtgggtggcagatcttgttaaccacagtagttattatataactatgttattttcagtttacctgagcatgcagtttaaacatgagtccagcagattcaatgctagaggagatattcagaaggcacaggaggagataaacagagatgaggaataccagctctgcaaccacccagatttggggcaaatattagctccatcaattaccagttgtgtgactatgctgtaatgagtgtttgttcatgagataataaatatgaaatgtttcaatagtggctgacatatagaaaactcttaataaattatagttgttacagatctcattcctagttaacctatgcttgttttgagataaagattttctttttgtagtataaaaaatttatctggcatagtatcatgtatatgtggatatttccaatgtttataataacaacagtacataatagacagatgttgtctaaagatcttcaagtaagaattaagaccaaaaaaagccaacaatctgctaatgtagaagtctcattaatttatccatctgtacctttcttctaaatgagacactcatttcaagctcgtgctcatttctaggcacaagaggactggagaatggtctctatatatagccattcatttatcccagaatgttaccttttttttcaatgctgctttcccaggcctcagagaatctaggttcagttgtgcatttatgtgtttcatctgctccatgcaattgtctataagattggctgaaagacaaaatctgcagtagtcaaaaggatattctatttccaagtaagttataaccacatataccaatcagattctcaaaaaggtaacattttctatttctgacccacttcattttagaattttcagtcagagattaatgaatcagaggggggataagtaagagaactaaaatgctgaagtccacttgttttcagtttttagtaagatactacccaaatccaatttacaacttgaggaatacatcatttgttgtagtcgcaaatcacaattgatattaatggacttgatgttgccattattctcttttaattctcagatctacattctccgattcccaaatgagaaattacaacactcaagagggaaatttatacgaaaatatggaatcatctgttgctgtttttaccatcaaaactatgtgggttttgttcaggtatgcagtgagtgcttctggatagtaatatttaattataatgaaactcaatgtgttaccttttagcttccctaatatttacatataggttctttagagcaagaaccatcacatattaaacaaacaaaaacaaactatgtctaatctttttatttgaaaagtaatgcatatttactgcttctgtatgggaaaaaaaattatttttagtgacactgagattatactatacgttttttacattttgagtccaaagaaaattaacttgaacaagcaacaaaacatatgaattgataatgccatcaaaacagctgatgtgtcatgtggctcacctttcaaagcatgtttctgtgctcttctactgacagccagcagtgacatcaatgcatttgcagctactcttttcaggatatctttggaggatttcccttcatagcactgcagagaatataaatcaaactgccttgaagaaatatttaatctggagcaaaactgttgtgaataaagaacattttctacttaaaagatattgctaggtttcaactatcatgtgaaattcactggattttgataaatcattaatatttgagaatgttctgcgtggataagactgtataagttgcttataatatggaaaagaacaacaatcattcttaaagactcatcatctacagaaaaaagctttatttagctttcacgtagcaagctcatatacttactcaaattcaccagcgcatattgtatatatatgtgtgtaccttattaaaatgggtccttgtaaaactgctgaacaggagaactgtcatcaatttcctcctttctccttctggggacacattcccctctctccatttctatctaaactacccctatatctcaggtgatttggttctttccatctttcgtttctatggtaacatgcacctgtcatataacattttctcaaaaaatagtgtgtaacttttttgactttcagagaaatggaaaatcatttgtaattccgaaactactatttctgtatatttcctttatacatttaaatttatgagctagaaaaattttcacttaaaaatttctaatatgtacaaaagcagacacaataacagattccatacatttttattaaaaatcaaaactagaaatttctgctccaagatggccaactagatacagccaggaggaacatctcccactgagggactgggacaccaggaagactggcacactcctagcagatcttcagagggagggcatcgagagcagatggagggaaaacacagagctggggctgaagggggaggaagctggggaccctgctcggggctaccaagcaccacaacttgttcctggcccccaacaactcctgcagagggggaagttgaaaaggcaaggaacaaaattcgctctccccacaggccgctggaatcctggtaggaaggaacccctggaccaccatggacatttgagttgtcagggaaagctgcttagggaagcagtggaagcagaactccagctggggcagagcccagagagtttggtatgggagtgtctatagcggagcatggccaaggatgcccatccccttaggctagacttgctcccataggagactttatccctaggggaactgtgggacctcaactctgcagggtggtcttgcccatgagatggggccaatctggtccaccctttggtctgctggcttctcccagagcccgagcctagccacacctgcttggagtgaagctcccaggtacgggcccatacggtagctcctgcactggcagactgcctgactagcagagtgctctagcagagtgaccccagtggacacgcaccagcattcttcccccactgcagcctccttcatgccgccttgcctgcaggcactcacccatctcatgcaatgacacacataggctcaaaataaagggatggaaaaaggctaccaagcaatgaaaaacagaaaaaagcagggattgcaattctaatttcagacaaaatagactttaaaccaacaaagataaaaaagacaaagaagggcattacaaatagtaaaggactcaattcaacaaggcaacctagctatcctaaatatatatgcactaaacacagaaacatccagattcataaagcaagttcttaagagatcttcaaagagatttagactcccatagggtaacgtgggagacttcaacaccccattgacagtattagacagataatccaggcaaaaaattaacaaagatattcaagacctgaactcaacactggaccaaatggatctgatagacatctacagaactccccaccagaatacaacagagtatacattcttctcattgccacatggcacatactctaaaatcaaccacacaatcagacacaaaacaaatttccgcaaattcaaaaaaatcaaaattgtactgatatggtttggatctgtgtccccacccaaatctcatgttcaactgtagtccccaatgttgggaactggatcattggggtagatccttcatgaatggtttagcaccgtccctttggttctgttcctgtaacagagttctcgtgagatctggttgtttaaaagtgtgtggcatcttgcccctctctcttcctcctgctcccaccatgtgagatgcctcgctcccccttctgccataattgaaagtttcctgaggccttcccagaagctgagtagatgccagcactatgcttccttacagcctgtggaaccatgagccaattaaacctcttttctttataaattactccgtgtcaggtatttctttacagcaatgtaagaatggtctaatacatataccatccacactctcagaccacagcacaataaaaacagaattcaatacaaagaaaattgcacaaaaccattcatttacattgaaattaagcatcctgctcctgaataacttttgggcaaataatgaaattaaggcagaaatcagtaagttctttgaaactaatgagaacaatgataacataccagaatctctgggacacagctaaggcagtgttaacaggaaaattttgagcgctaaatgcccatattgaaaagttaggaagatctcaagtttgcacctaacatcacaactaaaagaactagagaagaaagagcaaaccaaccccaaagctagtagaacacaagaaataatcagaatcagagctaaaggagactgagacatgaaaaaccattcaaaagaccaatgaagtgaggagccagttttttgaaaaaaataataaaatatatggaccactaggctagattaatgaagaaacgagaaaagatccaaataaacataatgagaaatgacaaaggggatattaccactgaccccagagaaataaacatcagagacgattataaacacttctatgcacacaaactaaaaatctagaagtggatgaattcctggccacatatatcctcccaagactgaaccaggaagaaactgaatccctgaacagaccaacaatgagctctaaaatggaatcagaaataaatagcctgcacaccataaaagccatggatcagatggattgacagccaaattctaccagatctataaagaagagctgataccattcttacagacactgttccccaaaaaaatgagaagtaggaactcctcctcaattcattctatgaggctagcatcatcctgacccaaaactggcagagacacaacaacaaaaaaaagggtcaatatccttgatgaacagcaatgcaaaaaccctcaacaacatactagcaaactgaatccagcagcacatcaaaaagctaatccactacgaacaagaaggctttatccctaggatgcaaggttggttcaacatacgtgcaaacaaataaacatgattcatcacataaacagaactagaaacaaaaataacacgattatctcaacagaggctttcagtaaaattcaacatcttttcatattaaaaactcctaacaaattaggtattgaagtaacatatattaaaataacgagagccatctatgacaaacctgctgtctacatcatactgaatgggcaaaagctagaagcaatccccttgaaaactggcacaagacaaggatgccctctttcaccattcctattcaacacggtactggaagttctggccagggcaatcaggcaagagaaggaaataaagggcatccaaataggaagagaggaagtcaaattatccctgtttgcagatgacatgatcctatatctagaaaaccccatcgtctcagcccaaaagctccttaagctgataaacaattttagcaaagtctcaggatacaaaatcaatgtgcaaaagtcactaacattcctatataccaacaatcaagccgagaggcaaatcaggaatgcaatcccattcacaactgccaccaaaacaaaacaaaataaaataaaacaaaatgcaatacctaggaatacagctaaccagggaggtgaaagatctctacaaggagaaatacaaaacactgctgaaagaaatcagtggtgacacgaatgaatggaaaaacattccatgaacatggctaggaagaatcaacattgctaaaatggccatactgcccaaagcaatttgtagattcaatactatccctatcgaaccaccaatcacattcttcatagaactagaaaaaacttttaaaattcatatggaaccaaaaaagagcccaaatcgccaaggcaattctaagcaaaaagaaaaaagctggaggcatcaagctacttgacttcaaactatactacagggctacagtaaccaaagcatggtaatggtataaaaaataaacacatagaccgatggaacagaatacagagcctagaaataagggtgtacacctagaaccatctgaccttagacaaacctgacaaaaacaaacaatggggaaagaactccctgttcgataaatggtgctgggataactgactaattatatacatacattgaaactggaccccttccttacatatatacagaaataaactgaagatggattaaagacttaaatataaaccccaaaactattaaaacgctggaagacaacctaggcaataccattctggacacagaaagtggcagagatttcatgatgaaaatgtgaaaagcaactgcaacaaaagcaaaaattgacaaatgaaatctaattaaactaaagcgtgtctgcacagcaaaagaaactatcaacagagtaaacagacaacctacagaatgggagaaaatatctgcaaactatgcatcagacaaaggtctaatatccagcaactacaaggaacttaaatttacaagaaaaaaacaaccccattaagaagtgggcaaaggacacaaacagacacttctcaaaagaagacatacacattgccaacaagcacatgaaaaaaagctcaacatcactgatcattagagaaatgcaaatcaaagccacagtaagataccatctcacaccagtcagaatggctactaagaagtcaaaaaataacacacgctgatgaggttgtggagaaaagggaatgcttatacacagtgggagtgcaaattagttcaaccattgggaaggcagtgtggtgattcctcaacaagctaaaaaaaggactgcaattcaaccctataatctcattacagggtatacacccaaaggaatataaatcattctatcataaagacacatgaatacaaatgttcactgcagcactatctgcaatggtaaagacatggaatcaacttaaatgcccatcaatggaaaactggataaagaaaatgtggcacatatacaccatggaatactatgcagccataaaaaagagtgagatcatgtcctctgcatgaacatggttggagctcgaggccatgatccttaggaaacaatgcaggaacagaaaaccaaatactgcttgttctcacttataagtaggagctaaatgatgagagcaccgggacacaaagaggggaacaatagacaatggggcctaccagtgggtgaagggtagcaggagggagaggatcagaaaaaataactattgggtaccaggcttagtacctgggtgatgaaataatctatacaccaaacccccatgatacaagtttacctatataacaaacctacacatgtaccccgaacctaacagttaaaaaagaatcggctgggtgagtgcagcaaggtggcagaatagaagcctatactgtctgtcctcccccaacaggaacaccaaattttaacaactatatgcacacagaaaagcaccgtcacgagaaccaaaaatcaggtgagcaatcacagtacctggttttaatgtgtacggctaaaagaggaactgaaaagtgtcggagatatagtcttgaatcaccacccctcccctatctatcagcagcagctgcctggtatggcgagctaacttgcacacttggaggagggagagagcagcgactgggggacttcacactgaattcagtgctgctctgtcacagtggagagcaaagctgtgctgggctcagccaacacccatgcatggagagatcatttagatcaactgcccaaaccagcagtcagaagtggagtttcttggcaagccttgccaccgtaaagccagtgctctggggtcctaggtaaacttgaaaggcagtcttggacacaaggcctgcaattcctaggcaactcctagtattaggctgggcttagagccactggactatggtggcatgtgacacagggagacaacagccagggcagctaagggaggccttacaccatttctccctcaatcccaggcagtgcggctcgcagcaacaaaagtgactccttccttctacttgaggaagagagtaaacaagactttgtcttgcatcttagataccagctcagtcacaatagaacagggcactgggcagagttgtgagacctccattccaggcccattcctggatgacaaaatagacaaaatgtgggccaagggaacccactgccttgaagggaagaaaccagtcctggcaggattcattacttgctgactaaagagccctcaggccctgaataaccagcagcaatatccagatagtacaccacaggccttgggctctgggacgtgctgactttaggtatgacccagcacattcgcagctgtggtggctacaacaaaagactccttttgtttgagaaaagcagaggggaaagtaaaggggactttgtcttgcatcttaggtatcagctcagccacagtgggtagagcaacaagtaggctcttgggctccctgaatccaggccgagcctcttggacagtatttctggaccatctctgggccagaggggaactgattgtcctgaagggtgagccccaggtctggcaacattcgtcacagaatgacagaagtgcccttgggctctaagtgaacattggcagcagcgtggtagaactcccatgggaccgtggtattggtggccaaaaggagagtctccttttcctgtggaaaggggagagaagagcagaaaggacccagtattgtggtttgagtgccaggttagtcacattagaatagaacatcaggtaaaattctaaggtttttgactctaatccctggctcacagatagcatctctggacctgctcagggtctgggggaacttactgctctgaagggaaggacagaaacctggctggctttgtcacctactgattatgaagtcctagggccttgagtgaacacaggtaagcaggtagcgactgcagtgggcttgagagaaacccagtgttgtgttgacatcaggactaatccagtgcagttccagtggtggtagccacagggatgctaatatcaccacatccccagttccaggctgctcagtatatagagagagactctgtttgtttgggagaaagtaaggtaaaagaacaagagtctttgcctggtaatctggagaattcttccagatcttatccaagaccaccaaggcagtacctctacaagtctgcaagaaacgaagtgttattgggcttaaggtccaattcccttggaatgcctgggaagcctcctcaaggaggacacacacaaacaagcccagactgcaaagactaaaacaaatacctaactcttcaatgtccagatattgacgaacatctaaaagcatcaagatcatccaggaaaaaatgaccccaccaaatgaactaaaataaggcatcagagaccaagcgtggagaaacaagagatatgtgaactttcaaacagagaattcaaaattgctgtggtaggggagctcaaaagaaattcaaaataagagaaggaattcagaattttatcagataaatttaacagagagatttaaataattaagaagaatgaaacagaaattctggagtttaaaaattcaattggcatactgacaaatacatcagtctcatattagtagagctgaccaagtaaaagaaagaattagtaaacttgaaggcaagctatttgaaaacacagagtcaggggaaggagataaaagaaaaatgagaataaagaagaatgaagcatgcctataaaacctaaaaaatagcctcgaaagggcaaatttaagacaaagagatagtggtagaaagtttattcaaagggataatatcagagaacttacaaaacttagagaaagatcaatattcaagtacaagaaggttagagaccaccaagcagatttaacccaaagaagacatttaagatatttcataatcaaactcctaaaggtcaaggataaagaaaagatcctaaaagcagcaagagaaaagaaacaacatacaatggacctccaatatatctggaaatgttacaggtcacgagagagtggcatgacatatttcaagtgctgcagggaaaaaaaaaaagaaaaacaacaaaaaaactttaccctagaatagtacatacgatgaaactatccttcaagtatgaagagaaataaaaaccttagacaaacaaaagctgaaggatttcaacaacactagacctgtcctacaagaaatagtaaagtgagttcttcaatctgaaataaaaggatgttcgtgagcaagaagaaatcatctgatgttacaaaactcactggtaatagtaagcacgcagaaaaacagagactattgtaacactgtaatggtgttgtgtaaactactcttatcttaagtagagagtctaaattatgaaccaatcgaaaataataactacagcaactttttaagacaaagacagtacaataagacataaagagaaacaactaaaagttaaaaagcaggggagataaagttaaagtgtagagtttttattagttttcttttgcatgtgtgcttgttcatgccatcagtactaagctgtcattagtttaaaataatgggctataagaaggtatttgcaagcctcatcatggtaaccttttaccaaaaaggatacaaatggagacacaaaaactaagaagaaattaacataccaccaaagaaaatcatcttcactaaaagaaagacagaaggaattaaagaatgagatcacaaaacaattagaaaacaaataacaaaacggcagaaggcagtccctacttgtcaataacaacattcaatgtaaatggactatggactaaactctacaataaaaacacacacagtggctgaagggatgaaaaaacaatgcccacttatctgttgcctacaagaaacatatttcaccaataaaaatatatacagactgaaaataaagggatggaaaaagacattccatgccaatgaaaacaaaaaaaaaattgggagtagctatacttagacaaaatagatgtcaaaacaaaaactgtaaggacagacaaagaagatcattatataatgataatgcagtcaatgcagcaagaggatacaatgattgtgagtatatatgtacccatcactggagcactgagatacataaagcaaatattagaactaaagagagagcgagatctcaagacgataatggctggagacttcaacaccctactttcagcattgaacagacagatcttccagaaagaaaatcaccaaagaaacactggatttaatctgcactaaagaccaaacggacctaatagatatttaccgaacatttcatctaatggctgcagaatacacattcttctcctcagcatatggatcattctgtaggatattccatatgttaggttcacaaaacaagtcttaaaacattcaagaaattgaaataatatcaagcatcttctatgaccagagtagaataaaactggaaatcaataacaagaggaattttggaaactatacaaacatatgaaaattaaacaatatgctcctgaatgtccagtgggttaatgaaaaaattaagaagaaaattgaaaaatttcttgaaacaaatgataatggggccaggtgtggtggctcacgccttgtaatcccagcccttcgggaggccaaggtggacggaacacctgaggtcaggagttcgagaccagtttggccaacaaacatgcgaaaaatataaaaattagctgggcacggtggcaagcgcctgtaatcccagcttcttgggaggcttgaggcaggagaatcacttgaacttgggaggcagaggttgcagtgagctgagatcgggccacgctgcactccagcctgggtgacagagtgagactctgtctcaaaaataaataaataaataaaaataaaaaataaaataaaaataaaaaattgctcactagcaattgggagcagggttgggtcggagttaagactcctaaggaaatagttgtgtgcacagatatgtcttttattccctcctgaaatcccattaaaatgacaaaaatgggattgcacacacacacacacacacacaagcctgaaaacgagaaagcagatggatgagaggcaagtgtattaggcttgggaaacttgaattctaagtggtgagtggggaaagctgaaaactaccccaatctatccactgaagtgcccaaggctgaagaaatttagcaccaggcatccctggacgtgaggatgaaggattgcttcaagtctctaaaatgcagttacatgcccagatcctgcccgccagccaccagtttctatgtaactaagccactcttcctcccagcccttgcaaaatcccggatgcttagtctctggagaggataaattaggattctgaactggcagagacaggaaaatttgtgggcaagggtattctactaaaacctttgaaggattaagtgaaattgtgcaaactaaattctgagacctcagctgtcgtctcctacttggctacataacatttggcagttgggttttcacctccaggaaagagatcagaagaccattctccagggaatctgataagccccagaagacaagcctacaaaataacccccattggtccccttggacagcaattgacaagttgcactcatatgctcagggatgtcaatctgctttgagtttcccagtcttaaatacagcacataatcaagattaccagacaccaagaaaagctgccaaatagaaaagagagactaaaataaatagaggaaaagacagcaaagagagattacatagcgaaaaaaaaaaacttcacaggagttccaaatgtacagagcatacaaagtacagggaatgtctctgaagtaatttagaaagcatgagtttatagatggaaagaatccccaagagagcccagtacaatggctaaaacagatccacacctggatgcttcatctaaacattttagaatacgagaaaaaataaagattctaaaaacttccaggaagagaaaaaccaggaattctaagggctttggaattttctttttttttttttttttttttttttttgagacggagtctcgctctgtcgcccaggatagagtgcagtggcgtgatctctgctcactgcaagctccccgtcccgggttcacaccattctcctgcctcagcctcccgagtagctgggactacaggtgcccgccgccatgtctggctaatttttttgtgtttttagtagagatggggtttcactgtgttagccaggatggtgtcgatctcctgacctcgtgatccgcccgcctcagcctcccaacgtgctgggattacaggcatgagcaccgcgcccagccaaggcttcagaattctctatagtaacatttggaattaaaaagaacagactatggcttctaaattctgaagtaaatgatttccaatccagaattctcactagcctaactataaattatatgtaagggcgataaaagactttcagtcatttagatctcaaaagacctcctcagtaccttttctctgaaagctaagggagaagagacgctacgcaaaaatgaagagcattaaccaggagagaaggccacaggagatgggagacagcatgcaggatgcaggagactgcacatagcacagaggtaaaggaattcctggaaccaggtgaatggatatcccaggatgacaggaaactgcacctagcacagaggtaaaggaattcccagaaactggtgaatggatatcccaggatgaaaacaggcaccaagtaggttagaaggaattgggaagagatttcttccaaaagatgaagcgatgaagttctgacaattctgaacacactgagaggatgtttaattctggcaaagagcatggagcttgtaagtgataacaggaaagtcagcacgttttaaaataatacaataattacctctaaggcaaacaaaagctgtgcaagaaaagaaagttaaacactctgcaacacggttcaactgtgtataacactgtcataaatttaataccattcacgctgcctattctctaattggcattatggtatatcaatattaggagaatgagaagggaacccattttggcagggtaggtgggtgaggcatgaaaaaaaagctaaagtctcattttccatagtaggaattcaacagataatatttaaaactgaataatcaagacaaaaaaatataagcatgttatttagagacatgaaagagaagctataaaaagtagctaaatgaggtataagtggtcacctctgagaatatgaggaatgaaggcagaaatctcctacttttagtaaaaacttacagatacaactgtttggttctctaaaatgtgtacatggtaaaactgaaatcaaagccccaaaccaaaaccaaacagacaaaaaggaaacaaacagaattaatctatggtaaattcatatactttccaacatatactgaaggaaaggctggagtgaagaactgactttctatcagtttccatacagtacttactgcagactgaaaagcagtctgagcatcactgcaaagagcaagtggacacgactggaagtgtgaggagcctggaggcagcaaggctgagaataaactcaagcaacagataactagcaaatacacaaaaagagaaaaagaaatcaagacgatatacagagcaagacataatgtcttttcatcaaccaaaattcatttaaatgtcatgctctttctagattaatcccttctgtacatttaagtgatgtagggtattctaggtcaagactttcttgctttctttccaaaaggtacttaatgtaaaaaataggctttttaattacagtgaacattcatcaacacaatgggatcttaaatatataagccttcctttcaacagatttacccttgaattttaccattcactaaatgtgagcacaaaatacatctaaaataaggcacaagagttcctcatttgcattactacttttagatatcagatcaaatataaggagcaaaattaattcattatctcaactgattaatatatcaattatagacaaaatctactacatatagagagatttttattgatcttgttatctatatgtatttgcaaataaaacatattgagcacagtaggcccctttatccttgagggatccattccaacacccccagtggatacctaaaaccatgaatagtacccaactccatatattctaagttttattcctataaatatgtaactacaataaagtttaattataaattaggcaggtaggagactaacaataataataacagaatagtataataaaaattatgtgattgtggcctctctgtctctctctctaaaatatcttactacaatgcactcatccttcttcgtcttgtgattcatcagtctgataaccaagattgctatactaagtgatgaatgggcacgtatcatatgcagcatgggtaagctagacatagcatgattcacgtcctgaggggagacagagcatatttcatcatactactcagaatggcatgcaatttaagacgttaagtattgtgtatttctggaattttccatttaatatttctggactacagtcaaccatgagtaactgaagctataaaaggcaaaactacagataagaggagactactgtatcttcataaactagggaaggtaaaatctctgctaagtcaaatgtgttcagtattttatggacaaaagacagctgaatatttcttagaaaatgctcaaagtctgaaaccacctcaaaatggacttagaaaaaaacacttacacatgacttaagatgtaagtatgaatactttcaacatgtatcccctatgggatactgctataaagcaccatttaaaagataactctgaccagacatttaactgaagttccaatacagtgatttgttaggaggatggagattttagaggcagctgaaacttagtaataatgtaataaaagcctatcattttgcacttgaagaactgaatcccaagaagttaagtgatttgcctaaggtcccatatcaaatgttttttgagtatgattttacagaaaacttagacctttgaaagacatcaattttagaatataatttcttcagataatttaaagactgtaatttactttgcttcatacagcacctggcccaaaccacagcctccatggacatatagtaagctacatttattacttatcaaaacgtgttgctgttgaatgtattctaataatattttaattcacatatcctatttctataaggcaaagaaaacagtgtttgtaatttaataggcccattaactgtcccaacttacattaggtacacattttgtcatgagtgtgccaggagtatacttcctctcttcactttctttgtcttaaacttgcctgtgcctttctaacagatgtcatgtatccaaattctactgcttacacgaacacaaagagtatgatttattaggaaacatggtttaaataattggttaatgtatccataccctcacaaaatacgtgatttgtaatttagagaaataaagaggaaaattagctagtcattaggaaaatcattgagatattctgtgactgtaggctatctcattttctttgtccaaaaaggtaacaaaaaaattataaacaaaagcttttataatgaataatattacaaagtattaggtaaaaataagggcaaggtaaatttcacaaattcctctagcacagattttttttttcctgcgtatactattataaactgattcattaccctacatggatccatatgcatcatgagtctcatcagagacccttcaaacacagcaccacaaacaacattaaagagttgggaaataaaatagccctggctttgcctggctggaagtctttaaatttcccaggtccaggaggattggttgcaggacacccacagtcatccatgcagagccaggctcccacacctattgccattttggcctcagcagggagggcagggcccagcacactgccctcactgcactcagtcctctgagtgaagtcactgaaattctctgacgagccaagtgtgtcagcaagagcaaaagcctttccccaagcagtaccgtgctccaaccaaagccaaagttgggaaatttataattaaattacataggggttgtggttgggagacttttgaaaaggtttgaattttcctccttacaacattctttaaagtgcaaaactggagactcagttaatcattgggaaataaagtctgttgttctgatggggaatgagaaaactgggacaacgtccagtttttgttttcaactaagaaaatttgagtgaactgacagtgaggtagtaggtacaggaaagctatggcctcccaagaataagaggcttttagagaaatgctttgaggaacgcttctcccctagagctctatccaggcttctgaaggcgctgctggagatggatgagaaaatgggggatgccttaacaggcttcttatctatgctggaaaggtaaccagattttgtagcacaagggagacaaagtcccctgaggaccctgtgacactctccacaggacagctcctgggtgaaccaggaagcattttcttcttactggcaatcctttctgcatctcaacatcatcaagccttgtgcccaaaatgcacaagcagtcataccagaaatatctgcatgatcatgactctcacaggcaaagaagtgggtaaaaatctccaaattctaagcaacaaagggactataacaaatcagcacaggaacaatcttctaagcaacaaaggaattataacaaaccagcacacagacaatcttctatctttgccaaacgtggctggctgattgggaagctgaagcaaattcttcaatcaacaattctactacttttctgcctttcagtgagaagacaaaaatcataaaaccacatgattaaaaagaataattctaaatactgaaaaatctaaaaatattcctatttgtaaaaaacaatgtacaactttaacttagtaaacacacagtttttaaaaaattactcatctacttataaaataatactttagtgattttagaatgttttctgattaacaaaattcttgattcacattttagactgtaaacataattttataagataaaacaggcaacagggcttggaaagggggcattttcttccaaatgtgccagacaagtccacttacctatacatgtaaccaaccccaaaaatctgtggtccatttctagaaatcaaatgtcacttagaatatattttcagagacgtagatatatctttaaaattacaataaattttgaaccataactgcatttctgaaatatatccattttggtcatgatatgaaacactgttttgatcaactgttagatttagattagtaatatttcacttcaaatctttacatcatattcactgaagaaactggtcaacataagcgggtggggctaaggaggagatagttaatttaactttataaacttttgtatcatttaaacagtcataataagcattactatttcttaatttaaatgactgagacagtttttaacaagaccatgactgaaagtcaatttatttaaacgctaaataaagtttttgaaaaaccaagaaatgacgtacctgaaggattacatcactaagttgttctagagatttctgattttcctgagagtcatcaagaagtgaagccactgttggactacagcataaatgtgttttgctcttagcctggagatgcccttttgcttcttcggtcaagagaacagaaaggaattgcaagctggcagtatacagggcaggacacgtggcagacaagcctgcacatgtgcagaacatatctaaaggaataatttcagatgtgaatgtttgaaaatttcttcaaaattcaacaaaaaggaaatcaagttgattttaaagtaactatactctggatcatctagattaccaacttgtgtgattgtgttgcaactgttaaaggagctggtgccaaccagaacttaaaagcaagacttagtatgcagtgttggcacaatgtacaaacaaatatttcatagcagttcagacagcacatgagtggtcatgaactgattcacaaacttaatacagagtggaaagaacagaccaaactgaaaggaatttacactgaaacagtcattattaatttcctgttgtgagaactgattttgtttaatcaaaattacatgtgttgttttacattttataaacttgaaaaattggatttataattttgtttgattttatattttagatttatgcttgtgtgataattataaccataaaaatttttacttagattttggcttgtacaaattaaagttacataagaaaaataaagtagtcagcagtagggtttcatgagaattatgttcatttaaatgatgtccaaatattagtcaagttcgagaaaagactcttatagataacacaagttacggagtgaccacgacatgttttaaatgtatatgggcatatgagatggcaattgatttaaaaaaataaaaataaacaaaaataaaaccatggcaaaaaaaatgataattgttattaatgttttcattaacattactattatgaaaaccatttatgcagtaagttacttttgattagtactattattacataaaactgtacacatattttgaaggaaggttttgaatttaatatgtatttattttatcactaaagaaatagtgttagataaataagtttaagtcagaggtcagcaaactttttctgtaaaggtccaagtagtaagtattttatactctgcaggtaactggctttttcacaactattcacctcaacttttgtagcatgaaagcagccatatgcaatatgtaagtgagtgtggctatgttccaataaaactttatttaccaaaacaagctgcaggccagatttatctaatgtgggtagcatcatgctttctattgatattattggtgattcaggtgataaactaattttcccccaataaatacaagaagaaaatcccaatgtcttaatcagtcaatctctttcaattattatattttaaacaaaataatgatatcctacgtggacactgtactccatggtagactcagaactcctacatccagaaaattaacaattctgttccttgttaaacatgcatttgccataattcttactatcgctttggttaaaaattgtatcatgcatttaagtttactgaatgatcaaatgataaaataaatgttaaaaaaaatcggtcagttgaattagcaggtactttggaagcttaaaataactcaattttgagtacatttaagtaggttgtttaaaaaggttacataaatgtcagttatgaatatttatgttaaaaaacagcttttttctatgctaaaatttaggaggcttcatgaaaaattaaagattagttattttaaaataatcatgtttattttagtgggcaactatcatgaaaaacataaaaataattatactatactcttggcatttctgtactataagaaaattctgatgtgatgagaaagttatttgtatcctaactttccatgttatcatgtataccagattttatatatgaagatgtatccacatacaatgtacatatgtcagaaaggatactggtttctataccaacacagtaaaatttatctcattgttttataatcatatcatatgtacctttataaaaccacaggcttacaactgacaaatgggatctaaactaaagagcgtctgcatagcaaaacaaactatcatcagagtgaacaggcaacctacacaatgggagaaaatttttgtaatctatccatctgacaaaggtctaacatccagaatctacaaggaacttaaacaaatttacaagaaaaaaacaaacaaccgcatcaaaaagtgggcgaaggatacgaacagacacttctcaaaagatgacatttatgcggccgacaaacatgaaaaaaaacccatcatcactggtcattagagaaatgcaaatcaaaaccacaatgagataccatctcaggccagttagaatggtgattattcaaaagtcaggaaacaacagatgctggcgaggatgtggagaaaatgggaacacttttacactgctggtgggagtataagttagtttaaccattgtggaagacagtgtggcaattcctcaagcatctagaaccagaaataccatttgacccaacaatcccattactgggtatatacctaaagttttataaatcatcctactgtaaagacaaatgcacacatatgtttactgtggcactgttcacaatagcaaagacttggaaccaacccaatgcccatcaatgacacagtggataaagaaaatgcagcacatatacaccatggaacattatgcagccataaaaaaagaatgagttcatgtcctttcaggtacacggatgaagctggaagccatcattctcagcaaactaacacaggaacagaaaaccaaacactgtgtgttctcattcacaagtgagagatgaacaatgagaacacatggacacagggtagggaacatcacacaccgtgtcgggggatgagaagcaaggggagggagagcattaggacaaatacctaatgcatgtggggcttaaaacctagatgatcggttgataggtgcagcaaaccaccatggcacatgtattcctatgtaaaaaacctgcacgttctgcacatgtatcccagaacttaaagtaaaatttaaaaaaaccaacagtggccaatataatgttctcaataaaacagagcttcagggatgacatctttaaaaagcttaaaaaataataaaaccacaggctttcctaactcgcttttatgttatctcaaaatgtgtttcaatttttcaaaaatgcatttttggggggctcaagaacactgcaaatttttcaaagcaagcaccctgatacctcttttatatgccatgctataattacttaactttagtgaatttacatacctaaacaggcagaatcattatctcgttttattagcagaaagcccccaagattatgcaagtatcttcttaccaatcgccgctgtccagtgcttggccagggccacggtaacaaacgggagtgtgatggcaccagctttcctcaggagcatggccagaagattaaataaatgtgtccatgtgtgataaaaagctgatattaactctttatctataaaattaatcaaaacacttcaagttattaacacaaagaaggaaaagaacctttcaagatataaaacttaccacagacgcttcattacacttaaaatgaggggtgtgcacttatcaaatgaagacaaatctaattcagcattatccaaaatttatttcaattaacttcttttccattgcttcttaagatatctcccctccaccctcctgcatataaagccacactcacaaactctcctcttattaaagcatactcaagaacaatcagaaggtgtgacaaactaaatattaagccatgactgcagaactacatattggcacattataaaaatatgtcattgtttgtgctacttttgtcagagtaagttttcccctatttcctttatcccctccagcagctttgggcaggggtgaaaggaaagcacagtgtgccaaggtcaaggtagaaaagaaagaatttctttgaagaaccaagaaaagtatcatcccacaaagaaaagtatgacgcaaaagaagattctgcagcttttcctatggctaaggatgtagcaattctaggatgaggacccattttcccttctctccactcaggtaaatggaagctggagagcagtcgctgaggactctctctgaccatgccttcagggggatctgtcatcttttatctaattccactataatgtaaactttataggacgttaaccccgaggagatccatctaggtgtacttcagcacctatgagatacttgaaaactgcaccttccccagggcaatccttggtgtttctcaacccttttgtcattagtggctctctaaagagtttatttcagaaaatgtttcctcattgccatccccacaagattttaattccacacatatactgtatatctctttatgtactatatgtatatctgtactttgtacataaaaaggctaagtatagagcttactgtttttattcaatacaggcttaagaagagccgaataaaacatttaagctgaaaattaaattaaaaattaaagacctattaataccaaatttagctttgcacctatacttgctgaataacttttcatgtaatttatttacttatatatatatatcatcacaatgtgtcaatttacatacataaattagcaattcatataaaaacaacagcaatataataaattcttataaaatcatttaaaacttatttttttcagaaaaaaattttaaaaacttctttaaaaatattcttagtgaacttttaaaactttttgctagatatgagaaaacaatttttaatttaaccagctaatagatatacattcagatattgacattttttcctttcagcgcttgatataattaatgatgggttaaacaacttttatgtaattaaatatatactactttcaattaattttcaaagctcaaatcatacagaaaagcaagaggatcaataaaaagcattcacaaggcagccaatagcagccaagatacacagaccaccttttgctatatgaccttgggatcaaacaatcaaccaaaggtcctccagctgctgtcatctattcaccacagttttgtggcactagtcttgcatacatcttgtgtatcttccatgaactcaacgtcaatgcttctcaaggaattctcaagaaaaaccaggaagagaaatagtaataagattgtctcaggtagagttgagctttggaagcctacaaactattttaatttctaagatgtttttgcctcaccctcttctccccagaatcaatgttcactccttagagactgggggtgatatcaccttgttgagcttgtccagtctaacctaataagcttagttagggtatcactgccacttgttgaatttctaaggaattactattcctttaacatcgagatcattttaacactgatgagatgctgagaactggctttgctgggtatcataacacacttcattttccagacctaaaaccaagtaaatccatagttcaaataaaactgaaaggcaaagagaattaccaaatggtcaattacttcattataaatgattgttttcattttcaaaacaattatattagattttgacaaagatcctactttgctttaattttctccactaagcattacattcaacttttcatcatagaatattttcccctggagataacattagatcacaaaatatatatacatttcaataatttaggaccttaggaaatttgtgatatattctagattggcttatacttgttattgggaatgttttattaagcttttggccttagccatagtttataagaatagttaatacccagaactcactgtactttctaacatcacacagagagctttgccctcatttaaactgaaaactcaagggtagtcctttattatactacacacttgtcttaattggtaccattaaaaggcatccaaactataaaacacattatcaaagccttccaaaatactagcaaaaagaaactcaaaaagtaaccttcaagtgaatatctgaaacagagtaagttttttttcctcagtattattcacttacattctaaactaaaacaattaagcttacctaatacatctttggtacatatggtgagaattccaatgatattggtgataagaggtttcacaagctcatcctgaatcacaaggtcaggctccaccaataaacatgactgcagaagcctggacaaagaggataggtattccaggagaaaggaaacctgtttgaaaaggagacagggtcaaatcaaacatgccatataaaaagcccatctcagtgatacagcattttacttttgtaacacaataaaaaataaaatattaaccataatttttcaagatctgaaattaacacatagcagacaaagcattatttttctcataagcatgtcattaacagccatattaatactgtcaactatacaccaaacaaagcaatgttttcaaagtcaagttttgaattccatttaaagaagtaaagtcttggccaggtgtggtagctaacacacctgtaatgccagtcctttgagaggccaaggtgggcagatggcttgagcccaggagtttgagaccagcctgggcaatacggtgagatcctgtttccacaaaaaatataaaaattagccgggcctgcagtcccagctacttgggaggctgagatgggaggaccacttaagcccagaaggtagaggctatagtgagctgtgatcacaccactgaactccagcctgggtgacagagtaaaaccctgtttcaaaagaaaaaaaaaagtcccatatttttcaagtagtcaaattatgaaatcaatattatggaagaagtggaaaagtgtataacaaagccataaagtctataattttgtaaagaaagaaagattacaaaaacacccttcaaagtgcataagcaggggtggggggaagctagcctagttattgctacaaataaaatgcaaatatgttctatttttgccctcagcataaaattactattattaattataaaagaaaaaattaaatcatcttcaatattaccaacaaaaccatctctggaatttgcctgatgctaatattgttaagtattaactggcaaaagtacttttcagaaaaataatcctctgaatatgtaacaattaaagaatgagctgtgatgtctcatttgtccactaccctcaagcaatgagccagttacatataagtgaattttataaagatattctgaaatcagtcattctctctctctgtacacacacacacatacacacacacacacacactttttttcctctcaccttattctggggttgtaagagtgtaatgaagagtcgagagcctgttgtaaatttgtggagtatgtgtctctgaggtcaatggtctcagactatttacaaatagttctgccctacttctcctgatgaatacgtcctccctttatctaatctgccaacttactttatataaaagtgtaggtggctccaggcttcacaaactcttcagtttgtgaaatttaatttgtttactgccgtgaagtcttgagacttcatattacattcatactctacactactgaaattatagcaagtctgacctctggatgtatgaaatattaccataaatagataaaccatgccaggtgaggcaagaagaagtgttatagagaaaacgctgaattgctaaagattcttttgtatatgatcacattcaagattaaataaaatattcatatcttaagagtagttgataaagtaactctttttctatgtatggccctcttaaaaaaaaataccaaccaactgaccacagactttaatccatcatacctttagcagagtatcaccccaccagcagggctctggccaccccatctgccgcaggcactcgcagcctgctccctcacctccccagctttctgcttaagtgtcaccttcaggaggcccctcccctttctgacacacccttttacccatcctcaattgcttttttccataccatttgtgactatctgatacaatgcattttatttacttgttcactgtctgtctcctgcatttatggcacagactctacgtgaggagagatgctcatctgctttgttcaaggatatatcactagcacctagaacagaatctggtaaagcagaggctcaagaattttctgaaatgagtgaatgatcttatataaataccaagagcccagaagcatttaatctacataaggccagctggtgcagtggttaagaatgtgggccctggaactgacctgcataggttggaatctatgtcagagaccttggacaagtcactcatctctctgggcctcaggcatttcctttataaaatgacattaatgataacttcatgattcttgtgaagattacatgaattaacaaaaacaaatgcccataaatgtttgctactgctattattcattcatcccacaagtatcaagtgagcacctgtcatgagacaagccctatgccagacactcagaacacaatggaacataacagccagcaaggtcctgacttcatggagctgactgtgcccctctggcctcatcttgccctcatagattctgctccagcgactccaccctccttgctgtttcttggataggccaagcataccccaacctcaggggtcttgcaatgaccataggactagcttcttcactaactttgggtcccacgacactgcctaatcatcctaagtggaatagccctacccttccaactctgacatcacttcctgtcccctgctttagtttttcttctgagatgtctatcatcttcaggcatatatggattttctaattatctattctcccaacttgagggaagggtctttgttttattcacttggagaagattcaggcacacagcaagtactcaacaaagatttgctggatggagagcagaaaaatggaggagacagtcattatgcaataggcatgctcaggtgaaaacactgcaccaggacaacagcttcaaagaccatgcgtgtagcattcccaaactttgtaatggggtctgtcttattcagctcaaagaacacatctcaaagcaagagatattggtctacttcacctttaattcatcacctcctaaataaatcttgtagcccttcttaaaatttgattttgaaataaaatttctgttagcaacagctacatgaataattgttaagcatgttttataaatagattctagctataggcaagaatttaaaactaaatatctgtgaaggaacaagaataaatcatttttatcaaattgggttttgaaaatacacataacttagccaccaaatattttaacaactttaactttggtgtaaataacagagatagcctaaaatcacagaagcaggaagtgaactataccaatgtccctctttattattaaagtggtgctccaagatatccagacacttgatcatacatttaaagctggttaatgatggagtcaagaatagaatctaggtcttcaaaccccacctctcttttctaacatccagacatgtcccatattaaaatttcaagtaacgtatttcgaataatctcatcataccatgtatattttgagaggttttcatccttttcctatgactagtatctcctcagcaagatttttatttttgacacctaacgtaaacaaacccacaaacagacttgagatgcttacctgagcctgagtgtgttcagctggaggtgatgaaggcagcagggctctgagttcctggacacatgtctgtatgagggtagcatctgcaatgctgtgacgatcagaaaaagaaaatccttcagaagattagtatactttttattaaagattaagaaatcagaatttgaagtttaaaggtaactcgaatacaattcaagagaaaggatctttataagcaaagaaaatgtttataaaaagatatctcaaagaatttcaaattgtatcctgggttaccttcaaacaggaaaatatcttgtcagagaaaagtgagaagcaaagagctgtgaagaaaatatctaaggaaacctaattaaaagcagaataaaatataatacagcccatgagtaacaggaaacttggtggttattttcctaataaaatagcaaaaatactggctaaaatagcaagaacactgttcatatttagaaagtaaaaaacaaaataaagtaaaacaggccgggtgcggtggctcacgcctgtaatcccagcactttgggaggccaaggtgggtggatcacctggggtcaggagttcaagaccagcctggtgaacatggtgaaaccccgtctctactaaaggtaccaaaaattagctgggtgtagtggcagatgcctgtaatcccagctactcaggaggttgagacaggagaatcgcttgaacccaggaggcggaggttgcagtgagccgagatcgcgccactgcattccagcctgggcaataagagtgaaactccgtctcaaaataaataaaaataaaaaaataaaaataaagtaaaacaagtaggatttttttaaagtcaaaaatgaaaaacaggtacggaaatatgataagcctttgccataaaaggtcttttaatgcccctgtggcctcaatgccacatcagactcttagctgactcgtaagaagcaaagaagatcctatccctagagctctattttggtcatcttcaggcaggagcatccaggaaggaaagccaactgactagcagttacttttccaatccgagtaggtacagtaaaaaaatgatcaataaatattaaagccagaacaaactcatactccattgcgtatcatacatgttaaaggaataattacaattgaatgaggtgaaacaaggaatacttcttttagagtttatattttctagagttttcttaatatcccagaaagaaagagaagacactatgatttggcaagaagatgcaagacatttcagatggtgtatgttcaaaggtaaagggacagagagacagagaaatgcaaataaacatgtggtcaaaaggaggtgggtatggttggctagaataaactgaacaccagaagaaaagagaagtaatacttaagggggtatcctagataccatcacttttaattctcacactaaccccattaaataggtgttaatgacacagtagggagtaatttcccaaggctgcaagctactgagtgaatgaactataattagaccttaggtcaacctgaattcaatatctagtccttttctactataccttcctagaaattcagaaaaattatgttacagactgattaatatcaaataagtaataaaaattcaaataatttttctttgaatttaatttccctaaattttatcagaatactttttgatgaaaagtttaatttcccttaacaaaataactccaaatgaatttaaccaataatttttcaacccagggacattattctgatatgaccactaaaaagatgaattcccaaagtccctcacatccattaagaacaggggatagcaccatattccttaagtgtgctggaggataaataaggtttagaatccatgaattttagaaagcaggagtttttctttggccttaatagtcaagataacaaactaatacaagtgctttaatagatgtaaaataaaaaccaccaagacaattctggcaaaagcaaaatcctagagttcaatgagcctaaaaaagaataaagctgtatttccaggtcacaagaaatcttgtatcaagtcatgaatacagtttgtgtaaatttatctcaactaacatgcctctctaggagtatttatctcttacctacagagaagttctatgagatgagcttgtcgaaaagcctttgcagtgtctctgggagcaatcgtcaagaggttgtccaagaggctgcacattgctgaaagaagagatggagtaacaaaaacacacagtttgggcaggggagcagaaagagatgaatcatgaggtggccgtggtgatgtactttcctggtgacctattattgaaaataaacataagaattattatttaccttacagctatgtacaatactcaaaagttcttataatcataggaaagttcctgaaaatgataatgtatagttggggaattgccttagcttcttggctcatcttaaccttgaggttaggggtcaggctacccctactactcctgacctccaccttccaccatgtgtggatgtagatgtgtagatgtgtacacacggacattgtcgtatgcagaagagacaggtcagaaagggcagaacatgacttcatgccccacgtattcagacactgagaacaaaaagatgatttacaatcctttttctgaaactcgaggggccaaaggtgtgtccaaattcaaataatctttaggttttcttcagagtaaaatcttactatttttattatttttaaatttttaattatggatatataatcattgtacatatttatggggtacacatgatattttgatacaggcatactatgtgcaatgctcaaatcaaggtaactgggacatccatcacctcaaacatttaccatttctttgtgttgggaacattccaactccattcttttagttattttgaactatacaataaattattgttaactatagttaccctgttgtgctactgaacactagatcttattcctcctaactgtattttgtacccactaaccatcccttctttatctctggctctccactctttagcctctggtaaccctcattctactctctattttcatgagttcaactttttttttttttagttcccaaatatgagttgcaatatttgtctttctgtgcctggcttatttcatttaacacaatggcctccagttccatccatgttgctgcaaatgacaggacttcattcttttctctgagtaatatttcattgtgtacatatatggttcattttctttatccattcatttgctgacggaacttagactgattccctatcttggctatcacgaatggcgttgcaatcaacatgggagtgcagctatctcgtcgatatactttttttttcttttagatatatactcagcagctggattgctggatcagagggtaggttctatttttagtttttgaggaacctgcatactgttctccacagtggttcccaacaacactgtatgagagctcccttttctccaaaatacttttagactttagaacagtaataaggtacctgcaccctacattagtgaacacctccattaacctttgagcattcccttactttctggcacagcaagatgttccaggttcatcttgttctttcctcgtccaagctctaaaattggatatttgttccaaagtgtcgattccctaaagtggagaatggagtttggaaagcaagatttgggcactaaatgtatacattgctatttagagtgtcattgtttctaagctagaaaacgtgtgtgtatatacgtatgcatgcacatacatacccctgggcacataaacatattttatctacgaattaaaaatcattaatttgcctgtaattccagaattttgtgaggctggggtaggaggatcactttaggcaaggagttcaagatcagcctgagcaacatacagaaacctatctctacaaaaagatttaaaaatgaaccaggcatggcggcacattcctttaatcctggctactcgggatgaggtgggaggatcgcttgagcccaggaggtggcaactgcagtgaactatgatcacagcactgtcctccagcctggatgacagaatgagacctcatctcttaaaaaacaaaataattgattcatactgaaagctccaaatataatccaacactccaaatataatccaacattaaacatcttccttcccttccatatttgtaatttccgttatgtgaaagtaaaaattctggctttcattgtctacaatatatttacttatttgccttgccttatgaacacaataagtagtttcagaatttctaactaataatactgcaaaaaataaaactagtaactagagttcaatgcttggttacagttcattttgccaatagtctgaggactaaagtcctaaaaatatgtctgagagttactggggttacttcctctctcacttcaatgctattcatgtgaaatgtagctggattaattggtttgtattccatgttattgtttcccatttttgttgattttatttttttcagcaagtaaaacatacatggttataaaagtcaacctatacaagaagatacatgcagagaagggtcactatcccacccctcaatctcttctacactgttcccatcctctcttatttcctaactaactcccacccattctcataattaatctcattcatttccagctgttccttcctgttttctttctacacaaatagatacacgtattttaaatttccccttctttcatatgcaaaagtagaaaactgtaaatatcataaactataaatactctttatcattgtgcttctttcttcacttgacaatatttcctaaaatttggtccatatctgtttgaagatatcctcccctctttttttttttttttttttcgtttttggagaaatggtctcactgttgcccaggctggagtctggtgcaatcatggctcactgaagcctcaaagcctgggctcaagtgctcctcccacctcagcctcctgagtagctgagaccacaggtgtgtgccaccatgcctggctaatttattttatattttgtagagatacagtctcactatcgtgaaaagtatctcccacctcagcctccaaaagttctaggattattggtgtgagctgctgtgcccagccccctctttctaatagctgtagttctccattgttattttaaaaataaattttatttataagtaattttgttatatgtttatcattatctatatattgttatatatctatcaaaaactatccttctacttacaggcatttgtgttgtttccatgttttataattacaaacaatgcttgctaaattatcaagtacatatgtatttttatattgctggagataaataaaagagaattcctagaagtggaattgtttaatcaaaggtaaatacatagttttgttatctattgccaaattcccttccaaaattatactaatttgcattttctctaacaatgtatgaaagtgcttattttccacagcctcgccaaaagaatgtactgccaatacttaattgttggcaatttaataaataaaaaagtatcttcgggtagtattaatttgtataatatttttccaaagataaaggctacttttaggtcctttgtgaattatcttttcatgttttctgctcatttttacatgagagtttgtgttcttttcccctcaaatattacgcctgtaatcccagccacttgggaaactgagacaggaggattacttgagtccaggtgttcgagactacaatgagctatgaccatgccactgcactccagcctgggtgacagagctagaccctgtctcttaaaaaataatgataaatctttggaaataaaaatggaaaaaattaaattgagataattctaatgaaaattgtccaaacaatttcaagggaaatctttcagtattcataaaatatgtattacatatcttcagcacttctagagcaagcatatatagaaaccttttttgaatttttctgtaaagagagctagttcagaatataaattgatacatattttttcaattttcttgctaatttattttgtaaaactaaggaggacatttgacaccctgatctcttatttccaagttttgaaaaaaaaggaatatacctgatagtgtcatatatcaccaaaaaattgtgaggattcatcctctgttcatgcctcccctttctgtgggtattctttcttttatatgcttttttttttttttttggtcatatatatgtgctgaaatgattggcaaagagtaaaattgcataaatatacattgaaagcatactatttgtggacgggcatggtggctcatgtctgtaatcccagcactttgggaggccaaggcaggtggatcatctgaggtcaggggttagagaccagcctgggcaacatgatgaaacccaagctctactaaaaatacaaaaattaggcaggtgtaccggcacacctctgtaatcccagctactcaggaggctgaggcagaagaatctcctgaacccaggaggcagaggctgcactgagccaagattgcgccactgcactccagcctgggcaacagagtgagactgcctccaaaaaaaaaaaaaaaaaaaaaaagcgttaatacttgaaaataaaataaatttaaaatcaaaggtaatccaaacaaaaaacagaaagcctgtatatccacacaaatgcctatatcacgtgatgaatgggtaactgtaatatattcatacagtggaatattatttgtcaataaataaatgaagttctgatacatgctagaacatggatgaaccttgaaaacagcacactaagtgaaagaagccagtcacacaagaccatgttatatgattccattcatacaaaatgtccaaaacgggcaaatctataaagaaggaaagtagattagtgattccgtagagtgccaagaatgggggagacagggagtgactgctaatgggtatagggtttttttgcaagatgatggaaatatcctaaaattgatcgtggtgacggttgcacaactctgaatatacttaaaaccaataaagtatacactttaaacaagtgaattatatggtatgtgaattatatctcaataaagatgttaaaaatcagagtaaggcaacatgcttttagagataaatgttcatgaaattcatgatcgaatttcatttcatgccctatgtcctgagccatttaaataatctgagtttgctccttttgttcttaagaagatcaaatgagtattttctacagttaaataattttatatatagtgaacatgaattactaaaaaccaatatggaacactgtttaggaaattattggaacaaatattgtaatgaaagttcaaagttttaattcagcaagtttttctaaatgtttcagaaagtattttttctgcatatacttatatgtatgccagtgtttaaaattactttctttttagatagtatagtcctttcaagtcaaaaatttaatgctactgaataaggcttatatactctctagaatttaaaaaaaaaaaaaaaaagcaaagttgcaaatttgaagcacagcagggttggaagcagttcccagcacaaggagcaaaatttatatattgccattaataaaaataagtcccaagttgtatattgtgcatttctaataaaataaagactcaatacattttatgtgcctttaaatggaagcatagccttagaaaatacttaaaaccagaatcgctttactttcaagtggattacttgtagcaaagtgttttctcaaaagaagggaaaaaataaagttaagttatacccatcagttcccaaattcaaatgtcaaatacctacgagcgcctaataaggagccacacaggaattggactatttatttaagagccaaattccatttattagttaagagcatttattttattaatttctgatatattggttctaaatgtatttcataatggtctacaacttatttcattaaaattttgttctttagacatttactttcaaaatatctgtctggaccaacttgtcatttttctttttgaaggtagaatgtcttcactaaaaggataccttgagccacaaactggtcatgggaggcttcaggtagaagtgttgttgactgcacaagtggctgaaattcagtactccccaatgaaggtgccacctatgaatcagtaaattattttacttattaatgttacagtacggaaaatgaaacacaggcaacatacacacaagatatccttaaacaaggaggtttaagacaaaattatactagttaggataactagaaaagattccatatcttgggagttacagcagtttttttaaatggcatttccacttcttaaaggaattgttatcatttacataaatcagtaactcaaaggagcagtattgacttcaggcccatttaggagtttaaggttcccataaggccaattccctcattgcccaaatgttagaaaggctaaaatataccaccttaactataatttattgtgatattttgcatttcttgattgacaataaagatatttttaatgttccaaatggcacatataaattttaatagtgcctaaaaaattagaagtattaaaagatttttctctacctcacctcctatcaaggaagaacactaaaaaattgtgccagtttgctgagattgcttcagaatacaacattaaatataacaaaatccgtggaaagcaagtacaatttcacctacaggtttataatgagcagaccgaccttctaagactgaaaaagcgcaaagtgatgtgtttgcgctaagaggtgttcaactaagcacctcttagttgaaaaacacttatgtggtgaggtcagataactcttttccttaccatcaatttctcttctgtgaagtaacatgaagtgcccatacctgggtagcctccatatcagtacatgcaacacaacattagctatccatagaagttataaaccatcattccagactcagatcctatatagctcacagtatttgtacattgattgtgtatatatcttaacacttagagtaccttagaattaccatgatgaaatgaaagcaaaaactaaggttattttcatttgcagtttctaatagtaaagagaatataaatttgaagaaattactaaaaatggaatatacagttttttaaatcccccttttaacttgagcccttaaccatctttcaccacattaagtaagtataacagtcatgatgccaagaaataagtgagaaagctgcagctaaaaaatgtaggctaagcacataatctaaaaagtaaatctggaaaaaagttcagtctaaataagtcaatcataaacaaacatcaaatgccttattttatatagtattagatccagatactaagtaaaaataacctaaagcttgtttattttttttttttttgagacggagtctcactctgttgcccaggctggagtgcagtggcacgatctcggctcactgcaagctccgcctcccgggttcacgccattctcctgcctcagcctcccgagtagctgggactacaggcgcccgccaccacgcccggctaattttttgtatttttagtagaggcagggtttcactgtgttagccaggatggtctcgatctcctgacctcgtgatccgcccgcctctgcctcccaaagtgctgggattacaggcgtgagccaccgcgcccagcaagcttgtttatttttaaaaatatatttgcctacaatttggcaatgagagatatgtgaaaaaatgttcctgtcaacagatatcaagacaacatttatagttctgtgaagaaaataatcctatgccaagactgatatcacaaactatgcacaagctaatatatctggctcctgccacaactcttttggttgtataagaaaagttaaggggataatgatgctgaaatcctttatcatttcactgaacattctttcaactgataaagactcaagaaggccttattactgatataaatagaataggtacctggtttgcggtttcaacgatcggtgtgggaaaagaaagcttataagggcccactaaatacctggctcattagaagaaagcaaagttgtgattcatgacaaaggtcaggcattaataaagatgtgattttccttagtatagtccacagaagggatacacaagtttagaaaagatgcttttagaaagtaccttattgtattataacttaccccatgtggttggggaaacacaatgattgctttatatggtgctttaaaattgattatggatgatttatatttctactagcctctattttttaagtgtgctaaactaatatattgctattttaataactaaaagcaaaaaagtattaaagcaaattgtcccagttctatgctcaaatctttgcttgtttagatataatctccaatcgatagtatttggttacatttgataaagtacatcgatatgtaaacatgttacttttcaccttaaaatccaagtaataactagacaattttggcattaagtattagctactggaaggtgcagtatgagcctacgaagctataggtacaaaaagcctgacctagtccacgtcctcatttagagaaaaggaccacaagttaagggatttgtctgagttgagactaggattctcagtccagaactgcattcatgacagcataaattcgttagaatcagaggaagtcctcagacgtacctcttgagaaagctggctggccttgtttgcgaggagaggcttgcttctttctccctgatccccctgtgtccccgcggaacttcagctagactaacttcagctgccccatcccaggtgaaggaggaggaattggcttagtttaagagcaaacttagtctgctgaagtcatccgttcctgtcaagcttctcgctgctctgctctgtacctcacagtaagtaggataactagggttgtcctcttacaacagcgagagtctaattcttgtatctatcacttgctcaattcattagaatggtctaagtgcaaaatcacaatctagacttttccctcgctttcacatctgccacatgacatatcctgagatcttcaatttataatccctcggtaagacaaaaaaatctgaatttgaatatatttctagccttattactttacagatattacaaaagacaatacaagctttttagagcaggctgatgctacttaaaggtactgtcctaaaacagactcagattagtgtaatggatgttgctaggggataggagctggggaaaaggggagatgtttggtcaaagagtgcaaactttcagataagatgagtatgttctggggatctaatgtgtagcatggtgaatatggttaatatggtctaatgtgtagcatggtgaatatggttaatatggttaataacactgcacagtctacttgaaagagagtagttcttaagtgttctcaccacaaaaaaaaaaggttgactcttaggtgacagatgtgttaactaatttgactgtggtaatcatttcatcacatatacatatgtcaagtaatctcactgtatatctcaaatatatacaattttatttgtcattttagctcaaaactaggggaaaataaaaaaataaaatggactcaaatcttgcttataaaaactgaaaaaaattgttcttcagtgtgtttgtaagcagatttggtaactaaagaaggtttctaaattatgcttcagtgtaaaataagcagctaaaattaagaaagtccctttgaaatcactgaaaatagcagagtcatttgccatatccaagtagaactggaatgtaaaaaacaatttctgtcatataagcaaaaatgcatcaatgtacaaaaatgattttctttgtatctgccttacagaagcaagtgatttcactagacactttaactttttttgaaagttaattcagaacttgaatattgtatttgccaaaatgatcttgtaatagttccatcaacttccctcaaaagcagtactggtgccaaaaaagtttatttaattgtttttaaaaaggtacaaagggagaaaataaggattgtagtgtgaaaaaaataaagtacaagtctagccacattttgaaaacatggaaaaatataagatatgaagggtttctaagagattctaagcttcatgtgttcattttaataaataatacctttctctatatgcccaggagcaggaaagctttggcatgcttctcaatttgtaatcattaattctaaccaaattataacaagaagtttaaattatttcaactaatagattcataattcaaatggattatgtacaatatatgtaaaaaaaagaaagctcagaaaagtcctctgaaggaatgagcagaagatgatagacgattcttgcatgtctaaccaaaggaccacttaaagagacagatcatcaccacaacacagtcacagttcctgtgccatcctgtgtgtaatctaagagcacaaatttccaagagcttgtctcacttgtattttcctcctaactaaatataagaggttgttagactctggataatccacaggtagctgaaatttatttaaacagagtataacattttctttctctctccatcatcacacaaactaccacctcctcaagttttcctggggtcaccatgctggaggtatttgtatgtcctatcagtgatgcctatgtcaaaactatttttcttttagaaagcctcttggatccatccctgcttaaactatcctctgtctactcttccttctataaaacaattttaactaccatcaaatgagtgtcaatacgttatttctctcatatcagttgtaatgtttcatgccattccatgctgctgaaatatccttacatctttatctttatagctcttatatcttacctcttcaaatccaaaagctgattcagctttcttaactaactcctatctgattagtcaggtcatcaaactttagctttccgtcccacattctactccaaacaacctcttgcattttctgaatgttaatgccttcagtacaacacaacttcatatttagttagaaagtctaagtatgctttatgttctcaagtagacttttgtcatttgttaagtggtcactgaatcctaaggaatatttgaatcttttcagtcccttgcaaatgtttgtatgcatataaaagagaaggggataatattgtaaagcccatttcagtggccacttcctacacaaaaccacttttcatttcatctttccctctaaagaaacctcactgtcccttgactacaccatcttttatgggatcaatcacatctggccttagagtgaaggaggaagcaaacatacttctggactcaaaagaatggtctaccagttaccatgctaggaacttgaacaagcatgcactccatggagtgggacctcactccatgccctaatttcctcttttgcaaaatagtaacaatgcttttcagttgttttaagactatgaagtgtaaaaattctctttaaatgtttagaaaaactaaaatcagttttctttaaatctgtgttccagaaaaaagtttgaaagatcacatatttcacaaagaaaggctcaaaaagaaaggaattatatttcccacatattttattttgacaattgataaatttaaaaaaatacagacatagttctgctcaggaacaacagaagagaccaaattttggtcataaagctgttgctgcacacaggtgtgtaagaggcacaaacagctatccatcttggatataaacgtgatttcgagaagaaaaacaccacctaatggctgcatcctcctaccccagaggaggagaatattgagttcgatagaggccactcctgaggaagcatttacaagggcgatgccccaaagctaacaatgacactctgcttactctatctgcagtttatcaaacatacaggacccaacaatccttacgaagcttgccaaacaacggaactaatacacattaggtaacagcatgaaagtccctaacttggcattaacagcacaaaatggatagtaacccaggagagcatgctggatgacatgacccaaatcaaaagatgatgctttccttggaaagataaaatggaaaaaccagccaactaaccaataaaggattgcattttttctcaattctgagataaacaaaacaaagatataaataagcagataagctgattaataagatttacatccactcaacttatacctcaatttgtaacttcaacatttttttatacataagaaagtatgccttggtcgaagtactgacagctttggtttaaagtaacactggcagaatgaaaacactctccagatttttctcctgttgggacaaagatacacatcatcttgggtatggtaaagaaaatataactagtagaattagggtacgaagactatttttgtaactaaaagtcacccattctaaaagttgtttggaaacctcccgaaaaagaaagtaaaaagtaaattctgtaaaaattctaacagaatacactagcctttagagaaaataataagaaataaattttacacatattacaaaattcttttaaaaaaactgaaaagattccattggtatatatttctaaaagtctgtgttacattcaaacacaaacaagttaaagaccttcactttaattggggtgcttctttctttaataatgactacaattaataacatatttccaaattttctcagaaaatctagtattctaacctgtaagattaaatgttattacaaaatagagaaattcaaaaggttgatatgcttttgctttttgtatttaggttttcttgtataggataaatatgacttcagtgctcaccacaaaatagctaagataactcaaagttaattagagcaattattatttactgagtacctactaaaagcaaaaaaactgaaatatgtacaaagatttcaaggctagtctatagcccttttgacaaataggctaacaaacaaaatttacttttaagcacactttcatgctgtccttctgtgaactaaataaccaattaagacaattcagtttggcatttatcatattactgctcttgttgagacaaaggtacacactatctccaccttggaaaggaaagcatgacatctagtggaactcgggtaattatcttacttttccatacaaaggtccaatgtagcactaaacacaaatacttctcttgaatctagggaaaaaaagacttaaaactgtagcaaaaagtatcagtcttttgagaaactaggagatagattaaacataatctttacattataatgtctgtataattattattctcatattatttttgttcctggaaacaggtgtatcaaatctttcccttcctgatatgttgtataatacactaattatttcaaaaacactttaaaattaaaagtaacatttcccagttgagaataaatgattctgtatgtttgtaaataactgaaacctagtatcaatcattccttataaatactcagtgtttcaaacttttctgcaaaaaaagcaactaatgcatgaatgaaaggggaaggaaagaaggcatgcaaacaggcatatataaatttcaggtattccagataaacttctatgtgatgcaagtatttagaagtgtgtttaaagctgtcagcaccacactagaatcatttgaatgttcttcatattgccctgcccttaagcacaatttcagggtaatcaaccatttttaacatgtaggatttgttctcttctaatactaacgaaaaacatattttcacactttcgtactatcaaaaaaggtaggaaagagaggttgaaaattctcaactaaagggatattcagtgtagctataccgtagcaagacacaccctggttcaaactccagttctgctacctatagcactaatgatcacaaagttactttacttcagagtggcttgcgcacacagaaaagcaagataagtatctataatgtatgactgatgtgcagcttgaatacaataatttagcaaaattctgcagaaagcacttcgaataaatcatagctgttataaccttacactttgtattcttaactctcccactaggcaaactcaaattttttcagagattcaaaataaaggacttatgcattctttgcaagtaccgttgtttctgaggtggagagagaacttggatctcgatcctgacttgtcctagatggagccctccaaaacttgaatgagtcatctaaacctgcaacaacgagaaaattgttaacatggacaccctcctaggaactgtaacaattaattaaaagggtacgcattacaggaaaccaattcaaaactaaagaaaggaaaaaacttatatggatctggcttctgagatagaccactatttaaaaaaaaaaaaatctaaggagagtttttttttaatgtgcataagaatcactgagagcttgctaaagcagctgcttcagccccagccccagaggctccaataccccaggtcagagtggaagccctgagtgttcacttctaacaagttcacagaagatgccaatgctgttagtttaagggccatgctctaagtaactgatccagagaaatctaaacaattaagtgagtcacttttctaagagggatatttaaaatgttcaaaacttcatcaaatctcattttcttgattcttccaagaagtaaacagaaaagtgaatcacacattcacacttaataattcggggataaaggaacttcatgtcttcaacttactcttaaatggctcaaaaagagtatatatagatcatacatatccgtttatttatacacacatacacacacatgtggcaagatgtaaatactgtaaaatgttaacatttgagaattcttttgtactattcctgaagcttttctgtaagtttgaaactatggcaagattctaaaaaattattataaaaatgaatttaaaaataaaagctatttatattattaaattactatttattacaagatataattatttttatgtgctcagatcttatacttagcaaatctacaagaacctacaaacaaaaggaataaaaaggtttcaggaaaatattgtgacaaataagtaacatactaaaataaataactttttgatacatgagcaaaatgaattagaaaatatagtgggaaaaagtctcattcacaagaaggataaaaaaactgtacattgcctagaagtgaaagttccaaaaaagtttgagacgttaacagagaaagaaactataaaactgtactgatgggcataacttataaagtattaataagatgtcaaaaataatttccatgaagaatttataacatagaaaaatgcttgcagaatatttagtgaaagaaggaaatacaaaaatgtacacaagatatgaacataattacataaaacaaacaaaggctatacagagaaagaagacgggaagaaaatacatctctctgggtggtagaactggaaatgaatgttttccctgtatactttcatttttcaaatttttaaaacaaatatatgtatttttaacagtttttacaagttacatattacaaaaataaaaatacaaagatatcgtacttaccatttaaatcattgctttctgaatttctatcaaaagcagaaaaattcaaatcaaacatacaccgtcctaggtaacaatgctttaccatctgattcaaatgttcataaaaatggcagtgatataaaagagcctgaagggcaggttttccaatgagcgataggccagagtcctcatcatgaacacagggaccctgtaggaagagagggaaagaaggaggagacactgatttatccaacaatttccttaaaaagatccattgtctcctctcgaggaaacaaatgggtcccagatgctcccatctccttccactctgcttttgtccttacacagttatagcagcctgacctaggacaaattattccataatactctaggtctttgctgcctaaacacccccgtgaagggacaaagctgatctttctcttgaggggccatttcatttaaaatgtttctatggaatgatcagctttaaccaagaaatcatatacttgcaccaaaaacacaataaaagcagtatttttcaacctacatataatagtaaaataataggtgttaaaatatatgaaataaggtggtccatatattatgttcagaattattttttatacctatcactaagccaggtaaaatgaaaaggtccatcaatatccatatggcaaaatctgtcacattacttcccactgaattaatcctgacaaggaaaaaaaacacacacatgtatacatacacacacatgaactgccaccaggaggctgaaaagaatctgctattacacaatttttctctttgcatttttcccaaacaattttttgcattgtgacttactacttttcctggagtatctaatagcaaaaagcaagcaatgaggattggtttgaagtttgcaaataatcctaccattagtttataaatatttctattttctgggaaatgataataaagttaagatttcaaaacaggccataagagagagaaaaataaaagatagcaaacagaaatctaagagccaacaggaaagatacgttcaaaacatattgcaagttgacctttaaccataagatttgtatgtgtgtctgttctctcaccctccccatcaccaaaagaagatggatattttaacttactcttcaggaagacaaaggaattcacaagttaaaggcacgattacactaacaaggttatttctattaacacttctttttaaggacatttatatacatcattataattaaacctcttcaatattcaatgtcttttatgactatgaagttgttactgctgtgttgtaataaatctaccaacactgtgagcttactcgtcctaaacagagcaatttatataagaaataagactactgtaatgaacagccagcacatggtggtcactgtcgttattttaaatgcagaggtctagaagaatcaggtaaaatagagagtaatacaaagtgaatggggttatgtggctcctgtttattaaccaaggtatatgttacaggtactggcgccctttaatacattaccttattttattatatagaatgaagtattcacccaaaatcacagtcaatcttaacattcacagcttcaagaaattctatcttttaagcaagttataacatacttaaacgtacaaaacacgccaaacacccaagagatttgcaataaactgcttaacatcacaaattagagtcctcattataataatatagggaaggaattaacaaataagacaagaattgtagagggtttactagcttcactccatctaaaaaattcaataaatcaaaagtgattaatcaaagttgtacaaaaactagttttcaaaatatattttataatgatacaaagaaccacttaaaaatattttgccatacagattatataaaattatgcaatttttcatatttttgcaaaattatgtctacatgaatgcttcctctatcagttaccacaacccaaaattcacaaacctttaatgaaaatagagaagagaatgtaaactgtataaatcttaaaaacagaaaaaaatgacatctacagctctttgagagatcttaaatctgctgattctttattctgttcaaggcctactgaggctgatggccataccaactgttaggaagacaagagttacaaacccactgtcttctaaaatctaacatttctttagtttttaagtattttagaagtgagaagttacacatgtaaatatggtattagaactcttgcaattattctctaaatatgtaaaattgtcacagtgataaagaacctagtttaatcacattttcccttcaataaattaaaaattcttttctagttcctattaatataaacacagacttagaaaatataggtaagaaagtcataataagagacacaaatttataactaaatctatcaaataaagtttagaatctgttctatttttcctctgtttataaatcatggtaaaaattatttagcctaccaagattgaagaagctaatttagcttatgaacaaaaaatttaatatcatagaaaatagtgcaaaaaggtttaagatatagaaatacaaaaggaaatcagagaaaataaattcaagaggcctaataagggacttacaatttctggaaagataaaatataacacacaaaaaaaggaaattcatcttaaaagaaataaatatgaaaagatttgtcagagccaaaaaaatatatagaagatccaaatcttcaaattaaggagcttaataaatgtcaagcaagaaaaatggaaaaaaggtacataataaaaaaattctaaacattgaggacaaagagatgataatgaaagaaaacatcagccataaagaagtaaaaagagtcagatgaaaattcaacttctcatcagtagcactggatgctagaatacagtgaagcaaaattcttgggaggaacaatcttcaccaaacatatggtaactaaccacactatcaatccagtgcaatttaaagacattttcaaatatgcaagaacttgtgatatttatctctcatgcacttgtcactagttaccactacaatcattttgagaattatgactaggaaaagaaattctaacagaagagaaaggatgattaagagcttagaaaaactttagacatgagacatgatatggacccacaatgtaagaaaaaacaaacaggaacctcaagggaaaataaatcacccaaatcaatttttaaattatatttttatatatacatatatacacacacacatatacatgtatacatacatacaaataccagaaaacttttcctctgagtattagatgagttggtcctggaagccgagataagaaagtgtaatcacagcccactaagtgtctctgtagtgagttacggttttcaacttttagaagcaacctacagataaaattgagactgcagatgagaatgtaaacataatcaacgctcacaaagcaaaaagtaaaaataaaactattaaagatgggtattagaaacggcagaggaaagactgaagaaaggacaggtacaatctcagccatgtcttactcatctcaaaatgggttggggtcaaaagatatgatgcatgggtgacaaaaccaggaagagcaagtgtgaccagtggagaaataagagcagtaataccactatggtactatgagatactgtggtatctgcaggaaattgtgtacatgagctaaatccttaggtactaaagtagtgtatgaataaatatattattgcaaacatgctatttagatatacagtggtaactccctgaagaattaaaatcagaggtaaaactgtctcagtgaatggagagggacagtgaatttcactataagctctattagcttttttttaaccatatgtatttattacttgaaaaaaaaatttcttctaaaaagttcaattagtgcattcaaaatattcttgaactgctcaaaagaaaaccgagtaatctgaaataggcacatattacataaaaattattttattttttatttaactaagcattaagcctgaatccccattctctacacttattaagagagctttataatggagccaagcccaggatatgcacaaaggatggccaggctcaggctttcacagataactaatggttcaagggccagaacaatgaagtctttcatgcacacactaggctctgctccatacatccatcagtaattgatggggttatcttctagcatagtggggaaattagagcaatcaggtctaattgctctgtctcaagacttctgtatcatgactagccttgccctcaggtgagttctggggctgccagatcgtctgctgaattgccagagagagctgagaaggaaagtaagaaagctcttcaaatcaccagaatgccattacaaatacatttacaaagaaaactgcaaattaattatgtcatatcaagctccaattaatttgaaaacatctttatcaagaatgcaataaatcagaatactaattttaaaatgcatattatactcctagtgtcagtgctaatatacccattagctataattgaaaaggtactagaagcaaagtaagaataacatttaagaagatataatattttcaaggagaaaaatgaattattgtcatatataacaaaaatgctataatccaaagactgtaaaaatgaccctaaatacattagaaatccaaaactacatgtaaaatatgaatatcattacaatgatatcagtttaccaagtactcattgtcttctggaaatactcatgatgcttcataacaaacaaaagataaaaataatacatattaatcatatcaaatatcaaaataatatataactataaatgagctgactatttaaaacatatacacagacaattactagctttgttcactcacaggacatagaagcaatgacaccccaggaacaatgaatacatctagaacgcagatcttggtttctaaataccattctccatgaaaagaaatcagagcccttggagcaaatatctgattccaggatggagctggacagtctagaacactttgctgtaccagaagtaaggaaatggctcaaatattgataaagacacaagaaccattatgaagaaatttcccctggccaaagcaagaatgatttgaacattgaaacaaataatgatagaaacagattatagcccattaaacaaacttaagaatcttcaatccatgctggtgtaaataagtgaatcactaaataagcaaggaagaatgaaaagttcttccttacagtagcatgtaataaacatagaaagaaatgatggagttaggaaatcatttggcaacaattctgtaataactgtttcaggtaagaatcatgaatggaatttaaaactaggaaaacagtgtggagatttcttaaagaactaaaagtagaactaccagtgggattcagcaatcccactactgggtatctacccagaggaaaagaagtcattatacaaaaaagatacttgcacacacatgtttatagcagcacaatttgcaattgcaaaaatgtagaaccaattcaaatgcccatccaccaatgagtggataaactggtgtgtgtggtatcacacacacacacacacacacacacacacacacacacacacacactatggaatactactcagccataaaaaggaatgaattaatggtattcgcagtgatctggatgagattggagactattattctaagtgaagtaagtcaggaatggaaaaccaaacatcaaatgttctcactcataagcgggagctatgctatgaggatgcaagggcttaagaatgacacaacggactttggggacttgagggaaaagggtgggaaggggtgagggataaaagatacaaactgtgtgcagtgtatactgctgaggtgatgggtacaccaaaatctcacaaatcaccactaaagaacttactcatgtaatcaaacaccacctgttccccaataacctatgggggaaaaaaaagtaaaacaaaacaaaacaaaaaactagtgaaagaaagtttgatgagaaacagatatttacagtctcagagcacctccttccaaaagaaaaaactgtaactttacaaaggacaaaacaggcagattctatctttactaagtaatcaaagttagtatcaccaacaatgggaaagagagatataatatctcttgacatgttgcactgagaacccatcacttctatggtttttctgccaaaaatgcgtaactcaaatctaaacctggggaaaaggacaaatctaattgaagtatattacaacaaataagtagcctgcattcttcaaaaatgttaagatcataaatatttaaaattttgaaactatttcagatgaacgaaagcaaatatgtaagacaagtatatgcaatgtgtattcctgagctggatcttggatccaggattggatttttttttcttttttttctattaaaaacagcagtgggacaactgaaaatccttgagtaatctcctaattatgataattattattgtgattatgtaagaggatatccttatttttaggaaatccacacttaagtgttcagaggaaaagaagcattatgtctacaactctccaatagtttagaaagaagacactagacagagctgaagtaaatgtgtaaaataacatttggggaatctgggtgaagagtacataaaaattgtattgtttctacaaatttcctataaatctaagttttttcaaaataaagtttaaaaagtctgtgtaccaattcaaagtcctgtcacaaacatggaaagcaactagagcatgaacaagtttatttaaatcacaaactgacaacccattatgttatttaagtgcatgaaattaccctttacatttaaatgtgagatcattttcaagtggaaagaactgaaatattattaaaattatgcataagctaccatcatcatacataacatgattataacaatgtttcctgggtacatgtcatcccctgtaggccataagcccaagaatactaaattggattatctgtgaatctccaatatttagacactcaacaaatgtttacagaaatgaactgagaaaattacatcaataatccatctctaatcaatagatttcttgttataatcaactctaaaattggttgttaaagtttcagggatacggatttctgacactagtcttcaaactaaacccagttatgaaaccatccacattcaggagtcttaactcctagtcagactgtgggaaactggtctgaaaaacactggacagttgggagccacaatacagtttcgtgtcaactgaatattggctctgttttctcttcttggcagagaatgtagtatgcagggtttttgtttttagagacagggttttgttctgtcacccaggctgcagcacagtgacacaatcatagcttactgtggcctcaaactcctgggctcaagcaatcctcctgcctcagtctcctgagtagctagggactacaggtgcatgccaccattccaggccaatttttaaaattttttttagagatggggtctcactatgttgcccaggctagtctcaaactcctgggctcaagtgatcctctcacctcagcctccccaagtgttgggattacaggcatgagccaccacacccagctgggatgtagctttgaatgaggctgagtttgactcaagaacaagaccaatgtttgtaaatatccctctgaaaagttagtgtcctgaatataaaagagctgtgacacaccaaagactgacacagcaggaactgggttctcatatccagcaggggcctggtatcaaggcccctggtaggagtgctagatgtcaagggaagacaggccgagatacttcatctgctcctcctcttggtgaccaccccacttccagtatgcttctgcatccacagaaaaataaaaggggacttatgctatgaaaattaaggctttatttctaactgtatttacttatgatattaagaccaaaaggataactcaaatgttttgcacattttaatgaatcagtcaagacagatggagcacttactttctctgtggtaggggttgggagaaacattttttaaaatataaaaaatgtagtcctgtcagaaacaaacattctacacaggaagattaagttaaatggtaagaaataatgcaaatatggaaaataacctaatttagtggtaagacattaaatgttagtgtctttaaaaggaagattaaaatgggaattgcagtggttggtaaaattatttaatactttaaaaaaataaattgttttaaattatttacttcctatcttgtccgagaaaagatttaaggcccattacaaggaaaggtaaattgtaacatgatagtaaatgcatatcaggaataaaagaaagaaaaaagccagagatatggaaaaagtgcaaccatgaataaagcttagaaggtaagctgggtgtggcagcatgtgcctggggtcccagctactcaggaggctgaggcaagcgtatcacttgagcccaggaactcaaggccagcctggacaacacagtgagaccccatctttttttttttttaagtacatacagaaaaagtcacaattgataaaagggctctactttctggcatctaacaataaaagggaaactcagctataatattattcataattcatatatgcatattattactattcacaagtacaacaattctatgtcatgacatgaagtaggaatttatgctactgtgcagaggaaggagaggaaaaggagtagtaattataaagagaatgcttcagaaagcctatgaaacaagagcactagcgggcattaatttagactgcaggcaggaaaacaaagtgcaaagcaatagaagcaattctctttgttaaaaaaaaaaaatcaaatatttacctcaaccaaaataaaattttaacaaagctcctaaacatgctgtttcatgctatatcctccacaacactatgaaagggacactaaaataagtaaatgaaacattttgttgaataagattattattcataattctaccaaagactgtttgaattttaaaatactggctatgtggcccctttttcatggttgcaaaggaccatgtgccccactagctgcacccagagacaaccatcttgtttccttcttgcagaagctgtttctactttggaatttcagaccccactaaactttcttaaaattggatgacagatatactgagttaactattttcactgccaaggaaggacacttacacaaacaaaaataaccaaaaaaaaaaaaagactgaaaagagaggaagaaaatctgagtttattaaaaagcatacaagattgtccttatttatctaatttttcctaagactagcaaaagttgtaatcaactattgtttgggacagcagtggctctccaactttttttattttggccaacttagcaaggccaaaactccaaaagctaacttaaatcactattttccactttttagtagaaaaggatttccatgatgaagactggagaataacaaaaccaataaactgcagtaagcatgccaccagcaacaaacaggaactttactatttaatttctaagagaaaaatatgaacagctacatacggttctgtattacaacataatgtcccaggaactttaatatactctgcctttatacttatttcaataattaaaaattcattggtagtacatcaccaagtatatccatgtacatgggtcactagtttaacaatgggagtagagattatttgtatttgagccaaaaacaacatgttttaaaatgtagtctccggataacaggtaccaaaactactacactattaatataactattaatcctgcatattccctccagttttgtctcctggttttattacaacatggaaagtagataagcagccattatcagaaggcaatgttaaagaaattacgagcaaattacaagcctgggatttacaatgactggtagggttaccctgggtttgtaaagtttggagaggtaagccttccaagagttaaatgctacctgggccttgacaaccacctggattcatgcttcgggtcatgtgcggaaacttgcccttgctacggttcagcttgtttcactaactcctctaagagtatagtctaattaaaacttaaaaataaaccttagatttatacaggattttgaggagtgaggtgtagcaatatgataaatatatccctataaggtgaaaatatatggataggtaaaaggacagaaacagcacatcttatatccccaataagtgtacttttgtatcttccaaattacctaaaactgcagcaacatggatggaggtggaggccattatctaagtgaactaactcaaaaatagaaaatcaaatattgcgtgttctcacgtataagtgggagctaaccaatgaatacacatggacataaagacagacataacagacactgagactcccaaggagggagtgggggaggcggctgaggttataaattacctaactgggtacaatgttcaatatttgggtaatgagtacacgagaaccccaatccccaccaccattacgcaatatacttatgtaacaaacatgtacatatatcccatgaagctagaatttttttaatgtaagctataaaaatgttaggtaaccatttactgatgtgatattcagaacatgaaaaagaaagttaacccaacagaaaacaaagcaagatacactataacccgcactgtgcactaacctagaaaaggaaaaaaagatgttaacatcaacacatatttaactatctacaaatttgtttattattactaaattagagaagtaatacagcaaagtgggtaagagactgcctagactcaaagcaaaggcgtaccactgactagctgtgtgatttaggacaaactatttaaactctctatgcaaaagttcctaagcttagaaaataaggatagtaacagttcacaactcaaacaattatacaagttactatgtcttacatttctagaagggtgcctaaaacatagtaaacatatgttaactattattatttgctttaaattattgtgaacactatagagaagaatttttaagtctggtcggcataagaacaaattctacgttctattttaagaggcccttgctgtcttgtatatagtttcatcaataatgaaatatactacttatactgaaaatttatcaccaattaatttgaaacatctactaggttgataattgtttaaaatcacccacctgccaagtataatcctttataatttctgtaggcattggaattacaaggagattctgaagaataaatgccgcctgaaaatgtaaaaaaaaaaaaaaaaaaaaaaaaaaaaaaaaaaaaaaaggtcaatactgccatcttgtggtcatctctgaaataaccaatatattgtaattaatagcaaaagacatctctggtcaactgcacatgctgagaggtcattatgagaattgtcaaactgtatttcttgttaggtgatgaccttcttaggtaatgaccttgttaggtaatgacctaacagcatatgaaattatttcatcaggaaatatatcttttcctatttcagaattcagctttattaaaaaatgatttgtataacataaattcttctggtagcatttaagaaatataattttaggtttctactatcccctttcagattacacacacacacacacacaaacacacgcacccctctgccccgctttctcccttctcttatacagactcctttcaataaaaacttgctaactagaaatacaaaccacaaatgtccaacttgactagatcctgaagatgatcaaattaaataatcatacaaataggagcattgattgtctgcttaatgaaagatgaaataaccataatgggagaatgacaggattaacaagaggattctaagaaactgacatttccaaccatgataactagaagtgatggaaaagctttaaagttgataaatcaagaagcagccataaatataaacatcactacttaaaaacatgaaggcaaacagcaacaaaactagccttttgagcttggaactggcgactgctaatggtggacccaggagctgctgttttttttcataagcctctaagtacaatttgattattgttttaaaaccatttacatgaatcattactttaacaaaagcagcaataaaaaaaaaccacaagctattcagaaagaattaaaatagggtttatttttccctctcatgttatatgataaatactacaaagagttattttgacagcctcttatctatactaaagcttcataaatatcagagacccataaatgctgagataatataaaagtaatttttcctgtgaactacctttcaatgcataataaaaaaagttcacattaaaatatagtatattccgattttatcttatcggaaggaaggactccagtttttcctgtgcatgaataccttttaaatcctctactgtcattttgtttgggtgttcacagacagaagagatcatggtcagtggtcagtccaccatgttgagcggcagtcaagtatcgcttacggataccatcacaaagaatttctaaggaaaaaaaggagaaaagacagacatacctcccggcgcaccatactacattctgactggtccagaagaatgttcaccacagttccccagagcccaccggaaatgttctgacaactgtttgctaaggccacacagcccgtttcaagggtggtcagtgctgatcctaatcccagtgaagtgaatctcacctgttcaaattaaagagaaagttgttgaatcaaataagcctttttcctaacatgaattcttagtttttctggtacataaatatcacactttaaaaaaatccattggttttatgatcctaaattataagagacacctatagaagacagtgtcctccattccatgattcaagaaagcagtaatataggaaaaattaaatataagcaaatttcaaagcaaagtaaaactgggtataaaaagatgcataaaaattatagtttgcaagcctttttctaaggaaagcatagggcacttacattttatgaacacaatttcaattcttcattcttaaaaaaggtagctattctttgttctacctttcttaattttttattgtttcttccaaataaatgattttaactttcttaaaacttctaaacaaagaggcaattatcattttacaaggcatttcgtattttcctcaaaagttattcaagagaaaaacgttcccaaataagattgatgtggtataatatgcttgctgtagaaccactgctgttcaagccacacgttttggtaaatttctgaattcgaatccaaaaatatagtttcaatgacagctatagaattttttaaaaatgcagtcataaaattgtcaagtagtaagtccaagttcaatgtgactaaaaaatgtatttcaaatatttctataaataagattttattgtaatagcatattttacttgaaaaaagtaaactggctaaaactggaaagaaataatacaaaattttgtattgtaatgcaaatgcaattttttgcatttaatttaatttcattatatgacacttaagtgttgcatgtctataatttccagatcctttttatttttttcaaaattgctaagcttctccaataattttccactcttctgaaggtaatagatactataaccttttctcttttatattttcaatctatactcgaacaaatttgattgaaaatgagggtgctgtgtactgaactgtgtctcctcaagactcgtatgttgaagccctaatccccaacctgtatttggagacagagctattaggtgattacagttaaatgaggttataagggtgggaccctactgcactaggaatggtggcctcaggaaggagagaaatctttctccatgtgcgtgctccaaggagaggtcatatgagcacacagtgagaaggtggccctctgtaaatcaggaagagtgccctaccagaaaccaaccatgttgacactctgatcttggacttgcagcctctataactgtaagaaataaatttctgtttttaagccacccagacaatggtattttgttatggaagcctgagcacactaatacagatttttgtaccaaggagtggggatgctgctgaaacaaatgcctaaacacatgaaagtgactttggcactgggtaatgggttacaggctagaagagttttgaggtggatgccagaaacgtagacatgggtaattctcatgagatctcagacaaaaatgaggaaagtgttatttaaaaaaggttatttgaggaaaggcaatccttgttataaagtagcaagaaaactggttaagctgtggtcatgttctagtgttttgtgaaaggcagaacttgtgagcaatgaaattggatatttagctgagaagatttctaagcaaagtgttgaaaaattggcttggttcctcctgattgcttatagcaaaatgcaaagggagagagatgaattaaagaaggaattaagaatgggtaagcaaaaagaaacaagaacaagatttgaaaaattctcagcctatctgtgcaaaaaaaatgagaaagcttgttctaaagagaacatggagggtgtggctgaatacccatttaagaaaaagatcacgggtgcaattcatggacttaatcagacatctcagcagaagccaggaatagagatgggattatatcagcaaagacattgccagtttgaactaaagaggacagagaaagatgcagagaatgaaggaaagctgttggacttcctggattctgtaagcaaatatgtgctacagtggtccctcccttatccatggggaatacattccaagacccccagtagatgcctgaaaccacagatagtgctgagccctataactactatgttttctcctacacatacatatctatggtaaagtttacaaattaggcacagtaagagattaacaataactaaaaataaactagaacaattacaacaatatgttataatacaaaatacataaatgtggtctctctctcaaaatatcttattgtattgcactcagccttcttgtattgatgtgagatgatacaatgattacataaagagatgaggtgaggtgaatgatgtaggcattgtgagggagggtttggctactactgatcttcagggtgcttttggaaaatgaaacctctgataagggaggactactgtattcttcaatgaaaagaatgacccaaaaaatgattcagagatccccaggctgctaatcccaccacaggactcaagggtggcttttcctccttggtttcaaagacctctgatttctgtgggccagaatgatgaccctgcccagtgcttcaggaacatggctgcccttgaagacagctttatgggcggggctcttgaagacagccaaaggggtggggtcatcccacagagccatctagacagatgctgtcactctggtgggcctgtaaggcacaccatcaagccaaagaacattatccttgagcattaacatctaatgaaatttgctttgctaggctttggacttgcttgggacccatcacttcttcctttttttcctatttctctcttttggaatgggaatgtctattctaccatcatcttttggaagcatataacttgtatgggttcacaggttcacacctgcagaagaattctgtttcaggagggtttatatctggagacttacccagatgtggtttaaatgacatttagatgagattttggactttagactttacagttgatttgggaataagttaagacttttgaggttgttgagggagaataaaagcattttgcatggaagaagaacatgaagttcaggggctcagggatggaaaactatgaactgaattgcgtccctccaaaactcatatgttgaagtctttatgctcaagtgactacatttgaagacagggtttctaggagataattaaggtttaaagagatcataagggagtggtcctatctcaataagactggtaacattataataaaaaaaaaaagacaaatctgtctctataccacccctccctcccctgccccacatgcatggaccaaggaaaggccacgtgaatacacagcaagaaggcagccgtctacaagccagaagaagagccctcaccagaacttgactatgccggcactctgatcttggactttcagcttccaaaacttctatgagaaaagaagtgtctgttgtctaagccacccagtctgtggtattttgttatggcagcctaagctaaaacagggcttaaataaaacataaggtagagtcactacaataatcccataatataactatgtatatgtatatatgttttgtgtcttttttttttttttgagatggagtcttgctctgttgcccaggctggagtgcagtggcacaatctcagctcactgcaagcttcacctcccaagttcacagcattctcctgctgcagcctcccaagtagctgggactacaggtgcctgccaccacacccagctaatttttttatatttttagtagagatggggtttcactgtgttagccaggatggtctcaatctcctgacctcgtgatctgcccacctcagcctcccaacaagctgggattacaggcatgagccaccgcacctggccccgtgtcatttgttttttaatctaaacacaatacacttgattctccttcacactcacctctgggtcccgatcaacccataatggaatcaaccaagccaatccttgttgagtaggaatatgttcttcactatgactacccaaaggcaagaaccaaagtgacatccactcctagagggaaaaaagggaaacagaaatatttgaggtaagtttctaaaaataaaatgcaggaaggttaaaacaagaatttttaatgaaaacaacgtgaaaatgtattttagacttggttttaatccattattcagccaaaaaaggcaaacaaaaaaatttgtttctctttaaaaagttaaacataacaattttttgacagaagctatttttcccataatgtagacaaaatgtagttttccagtgtatgcacatttgaatcaatttcaaataagattcagatttgttaatatacaacttctaagaaatattctagtcaaaaatcattcacgttacctaaaaagaaaagtcaaaagagacattttcatgtggcaagtttatatgcttgaaatgtgttggacacagcacattccctttcaagcaaatgttcagaagatagacagctttaacgcgctcaccaagctcccagcctgggccatcatctcatgggataagtgaagcaagcaaagaattgtgctctttgtaacaccttttcccatgaaggacatagcatttcctccacgctccacataaaaagaagtaatgacctgaaaaacaaatgtaaacaatttcatggtggctttattctcaatggtatataaagataaatatataactgtctactgacttgtatgaattgaatccttaccttataaagttgtaatatttttagtttatatacttaaaaatgaataagatggtaaattttatgttatgggtattttaccattgttaaaagaaaatattcttcagcctacataacatagcaagacccagtctactttaaaaaagaaaaaaattagccaggcatggcagtggacacctgtagtcccagctaccggggaagctgaggagggaggatcccttgagcctgggagctggagcttgcggtgagctatgattgcaccactgcacttggcctaagttacagagtgagatcctgtaatttttcaaaacaaaaacaaaaattcttagtttcaatatttttccttttaaagtctgtaaaaaaaaaaaaaaagatgtgtggtgccctcctagtacacagttgtaacttagaatatgcttataatatttttaaaaatgttatagcatccttttaaagagtttatgaataatttgtgctggttttcaaggggaatgcttccagcttttgctcattcagtatgatattggctgtgggtttgtcacaaataggtcttattattttgagatatgtctcatcaatacctagtttattgagaatttttagcatgaagagatgttgaattttatcgaaagacttttctgcatctattgagataatcatgtggtttttctcactggttctgtttatgtgatggattacatttattgatttgcatatgttgaacgggccttgcatcccagggatgaagccaacttgatcatggtggataagctttttgatgtgctgctggattcggtttgccagtcttttattgaggattttgcattgatgttcctcagtgataatgacctgaaattttctttttttgttgtgtctctgccagattttggtatcaggatgatgctggcctcataaaatgagttacggaggattccctcttttctatcatttggaatagtttcagaaggaatggtaccagatcctctttgtacctctagtagaattcggctatgaatccctctggtccttttcttggttgctaggctattaattattgcctcaatttcagagcctgttattggtctattcaggaattcaacttcttcctggtttagtcttgggagggtgtatgtgtccaggaatttatccatttcttctagattttctagtttatttgcgtagaggtgtttataacactctctgacggtagtttggatttctgtgggatcagtgctgatctcccttttatcattttttattgtgtctatttgattcttctctcttttcttctttattagtcaggctagtggtctatctattttgttgatcttttccaaaacaccagctcctggattcattgattttttttgaagggttttttgtgtctcttgtcgccttcagttctgctctgatcttagttatttcttgtcttctgctagcttttgaatttgtttgccattgcttctctagttcttctaattgtgatgttagggtgtcgattttagatctttcccccttcctcctgtgggcatttggtgaaacactgctttagctgtgtcccagagattctggtatattgtgtctttgttctctttggtttcaaagaactaatttatttctgccttaattgtgttatttacccagtagtcattcaggagcaggttgttcagtttccatgtagttgtgcggtttgtagttagtttctcaatgctgacttctaatttgattccactgtggtctgaggggctgtttgttatgatttccattcttttgagtttgctgaggagtgttttacttccaattatgtggtcaattttagaataagtgcgatgtggtgctgagaagaatgtatattctgttgatttggggtggagagttctgtagatgtctattaggtccgcttggtccagagctgagttcaactcttgaatatccctttttttttttctgaatatcctttttaattttcagtctcgttgatctaatattgacagtgaggtgttaaagtctcccactgttattgtgtggaaatctaagtctctttgtaggtctctaagaacttgctttacgaatctgggtgctcctgtattgggtgcatatatatttaggacagttagctcttcttgctgcattgatccctttatcattatgtaatgccttgtttttttttttatctttgttggtttaaaatctgttttatcagtgatgaaaattgcaactcctgcttttttttttctttccatttgcttggtaaatcatcctccatccctttatttcaaacttatgtgtgtcttgcatgtgagatgggtctcctgaatacagcacactgataggtcttgcctctttatccaatttgccagtctgtgtcttttaattggggcatttagcctgtttacatttaagattaatattgttatgtgtgaattgatcctgtcattacgatgttagctggttattttgcccattagttgacgcagtttcttcatagcatcaatggtctttataatttggtatgcttttgtagtggttggtactggttgttcctttccatatttagtgctttcttcaggagctcttgtaaggcaggcctggtggtgacaaaatctctcagcatttgcttgtctgtaaaggattttctccttcgcttttgaagcttagtttggctagatatgaaattctgggttgaaaattattttctttattaatgaatataggcccccactctcttctggcttgcagggtgtctgagagagatccgctggtaagactaacagggatgggcttccctttgtgggtaacccgacctctctggctgcccttaatatattttccttcatttcagccttggtaaatctgacgattacatgtcttggggttgctcttctcggggagcatgtttgtggtgatctctgtatttcctgaattggaatgctggcctgtcttgataggttggggaagttctcctaggtaatatcctgaagagttttttccaatttggtccattctccctgtcactttcaggtacatcaatcaaacgtaggttcactcttttcacatagtcccatatttcttggaggctttgctcattcccttttgttttttttttttctctaatcttgtcttcttgctttatttcattaagttgatcttcaatctctgatatcctttcttctgattcatcgattcggctattgatactcatgtatgtgtcacgaagttctggtgctgtttttttcagctccatcaggtcatttatgttcttctctaaactggttattgtagttagcaattcctctaccctttatccaaggttattagcttccttgcattgagttagaacatgctcctttagcttggaggagtttgttattacctaccttctgaagcctacttctgtcaattcaccaaactcattctctatccagttttgttcccttgctgtcaaggagttgtgatcctttggaggaaaagaggcattctggtttttggaactttccgcatttttgcactgggttttcctcatcttcatggatttatctacctttggtctttgatgttggtgacctttggatggggtctctgagtggaagtcctttttgttggtgttgatgctattcctgtttgttagttttccttctaacagtcaggcccctctgctgctggtctgctggagttggctggaggtccactccagaccctgtttgcctgggtatcaccagcggaggctgcagaacagcaaagattgctgcctgttccttactctggaagcttcgtcccagaggggcattgccagatgccagcagagctctcctatatgaggtgtctgtcaacccctgctgggaggtgtctcccagtcaggaggcacggggttcagggaccaacttaaggaggtagtctgtcccttagcagagcttgagtgctgtgctgggagatccactgctctcttcagagccggcaggcaagaatatttaagtttgctgaagctgtgcccacagctgccccttccccaaggtcaaaaatttaaaattttaagtgactacttgaaaaataaaatatctaaatgatcagatccttattatcttcctctaagtcatctttggagatatctaacatctgtgatctgtgtaatgatttttaattctagcttataaatgacaagccaagacctttgccagtattttctttcaacttgatatttttgtcagacctctggaattatacatcatgtatctgatttaaagatttaattatcatagtttattcacctatcataattaatcatgcttagttaaaaagtctcatttcacagctacaaaaagcaaatactcatattcaaatttcactgtgcagaaacaagctaatcttttattagaaatatggctcccttccaaaaaggaaacagctttaattactaagaaactatgaagcaaatcatttggaccaacaatgactttgtttcaatgttctctcacataagccttactttattctttaaaagatgaatttagtcattagtagtacaacagggatacctgtttatgtaattaataaactaagcagatagtcccaagattaaatgttaccctgctacaatttttaacaaaagtgacggattctttcctaatatttgcctgccatttaacataaagtcataaagattttctgctcgagatgttttatgaagcacaaaacgacctcctttttaaaccaaagcaagattggctaatcaaattttttataactgcgaaacattacataacagggactgtgctttttatgtatcctttagctaacaaactgttactaaattttattacctcaaagacaactgaacacagaatggactactgcctttttgcctacacttcttacctaaaactaagcccttttgttctccaatacattaacagttcatttcaatttctggtatttgaaacgtaggtgtgatctaaagtctttgcacgtaattttaaaacaaaagcacttctgatagtttctaaacataaatgaggcaacacttcacttcttctttagttaccgctgtggcaggtcctcacctattcctgatttcaaagagtaaaactcattttctagaggagactgactctgtaaaaggttgataaatagagtatttataaatcacatgacaaaaaatgctataaactaggtacttataggttcaattatatattttttttaatttttaaacttttaggttcacgggtaacgtgaatgtttgttacacaagtaaactcatgagaacaaagttacaacacatcagaatctctgggacacagctaaggcagtgttaagagggaaattcgtagcactaaatgcctccatcaaaaagttagaaagatctcaaattaacaacttaacatcacaactgaaagaattagagcagcaataacaaatcaaccccaaactagcagaagacaagaaataaccaaaatcagagctgaactgaaggaaatcaagatatgaaaaaccattcgaaaggtcactagatccaggagttgtttttttgaaaaacttaatgagatagataggccactagctagactaactgaattatattttaaatgcactagaggagctgactttctaagaaatattatcattaactctttaatatacctgttttttaaaattcatacatttctaatagacagcagaaaataactaattagtatactgacagttgaaccttttttaatatttataattaaaaaatgaagtttattttatttttttaatatacttaaagttctagagtacatgtgcacaacgtacaggtttgttacatatgtatacatgtgccatgttggtgtgctgcacctgttaacttgtcatttatattaggtatatctcctgatgctatccctccaccctcctcctaccccatgacaggccctggtgtgtgatgttccctaccctgtttccaagtttttcattgttcaattcccacttatgagcacgaacatgcagtgttcggttatctgtccttgcgatagtttgctgagaacgatggtttccagcttcatccatgtccctacaaaggacatgaactcatcctattttatggctgcatagtattacatggtgtatatgtgccaaattttcttcacccagtctattgctgatggacatttgggctagttccatgaatatagcagcatgatttataatcctttgggtatatacccagtaatggaatggctgggtaaaatggtatttctagttctagatccttaaggaatcaccacactgtctgccacaatggttgaactagtttacagttccaccaacagtgtaaaaatgttcctatttctccacatcctctccagcacctgttgtttcctgacattttaatgttgccattctgactggtgtgagatggtttctcattgtcgttttgatttgcatttctccgatgatgagcattctttcatgtgtctgttggctgcataaatgtcttcttttgagaagtgtctgctcatatccttcgcccactttttgatggagttgtttttttcttgcaaaatttctttaagttctttatagattctggatattagccctttgtcagatgcgtagattgcaaaaattttctcccattctgtaggttgcctgttcactctgatggtagtttcttttgctatgcagaagctctttagtttaattagatcccatttgtctattttggcttttgttgccattgcttttggtattttagtcatgaagtccttgcccatgcctatgtcctgaatggtattgcctaggttttcttcttgggtttttatggttttaggtctaacatttaagtctttaatccatcttgaattaatttttgtgtaaggtgtaaggaagggatccagtttcagctttctacatatggctagccagttttcccagtaccatttactaaatacggaatgctttccccatttcttctttttgtcaggtttgtcaaagatcagatggttgtagatgtgtggtattatttctgagggctctgttctgttccattggtctatatctctgttttggtaccagtaccatgctgttttggttactgtagccttgtagtacagtttgaagtcaggtagcgtgatgcctccagctttgttctttggcttaggattgtcttggcaatgcaggctcttttttatttccatttgaactttaaagtagttttttccaattctgtgaagaaagtcattggtagcttgatgaaggtggcattgaatctataaattaccttggccagtatggccattttcatgatattgattcttcctatccacaagcatggaatgttcttccatttgtttgtgtcctcttttatttccttgagcagtggtttgcagttctccttgaagacgtccttcacatcccttgtaagttggattcctaggtattttattctctttgaagcaattgtgaatgggagttcactcatgatttagctgtttgtctgttattggtgtataggaatgcttgtgacttctgcacattgattttttgtatcctgcgactttgctgaagttgcttatcagcttaaggagattttgggctgagacgatggggttttctaaatatacaatcatgtcatctgcaaacagggacaatttgacttcctcttttcctaactgaataccctttctttctttctcctgcctgattaccctggccagaacttccaacactgttgaataggagtggtgagagagggcatccctgtcttgtgccagttttcaaagggaatgcttccagtttttgcccattcagtatgatattggctgtgggtctgtcataaatagctcttattattgcgagatacgtcccatcaatacctaatttactgagagtttttagcatgaagggctgttgaattttgtcaatggccttttctgcatctattgagataatcatgtggtttttgtctttggttctgtttatatgatgggttacgtttattgatctgtgcatgttgaaccagccttgcatcccagggatgaagcccacttgatcatggtggataagctttttcatgtgctgctggattcagtttgccagtattttattgaggatttttgcactgatgttcatcagggatatggtctaaaattctctttttttgttgtctctctgccaggctttggtatcaggatgatgctggcctcataaaatgagttagggaggattccctctttttctattgactggaatagtttcagaaggaatggtactagctcctcttcgtacctctggtagaattcagctgtgaatccatctggtcctggactttttttggttggtaggctaataattattgcctcaatttcagagcctgttattgatctattcagaaattgaacttcttcctggtttagtcttcggagggtgtatgtgtccagaaatttatccatttcttctagattttctagtttatttgcatagaggagtttatagtattgtctgatagtagtttgtatttctgtgggatcggtgttgatatcccctttatcattttttattgcatctatttgattcttctctcttttcttctttattagtcttgctagtggtgtatctattttgttgatcttttcaaaaaaccagctcctggattcaccaattttttttaagggtttttgtgtctgtacctccttcatttctgctctgttcttagttatttcttgccttctgctagcttttgaatgtgtttactcttgcttttctacttcttttaactgtgatgttagggtgtcaattttagatctttcctgctttctcctgtgggcatttagtgctataaatttccctttacacactgctttaaatgtgtcccagaaattctggtatattgtgtctttgttctcactggtttcaaagagcatctttatttctgccttcatttcgttacgtacccagtagtcattcaggagcaggttgttcagtttccatgtagttgagctgttctgagtgagtttcttaatcctgagttccagtttgattgcactgtggtttgagacacagtttatcataacttctgttctttttcatttgctgaggagtgctttaattccaactatgtggtcaattttggaataagtgtgatgtggtgctgagaagaatgtacattctgttgatttggggtggagagttctgtagatgcctattaggtccacttggtgcagagctgagttcaagtcctggatatccttgttaactttctgtctcactgatctgtctaatgttgacagtggggtgttaaagtctcccattattattgtgtggagtccaagtctctttgtaggtctctaaggacttgctttatgaatctgggtgctcctgtactgggtgcatatatatttaggatagttagctcttcttcttgaactgatccctttaccattatgtaatggccttgtctctttagatctttgttggtttaaagtctgttttatcggagagaggattgcaacccctgcctttttttgttttccatttgcttggttgatcttcctccatccctttattttgagcctatgtatgtctctgcacgtgagatgagtctcctgaatatagcacactgatgggtcttgactctttatccaacttcccagtctgtatcttttaattggagcatttagaccatttacatttaaggttaatattgttatgtgtgaattcaatcctgtcatcatgatgttagctggttattttgctcgttagttgatacagtttcttcctagcatcaatggtctttacaagttggcatgtttttgcagtggctggtaccgcttgttcctttccatgtttagtgattccttcaggagctcttgtaaggcaggcctgatggtgacaaatctctcagcatttgcttgtctgtaaaagattttatttctccttcacttatgaaacttagtttggcaggatatgaaattctgggttgaaaattcttttctttaagaatgttgagcctggctgccccgtctgggaagtgaggagcgcctctgcccgggcgccccgtctgggaagtgaggagcgcctctgcccagctgtccagtctgggaagtggggagcgcctctgcccaggcgccccgtctgggaagtgaggagcgcctctgcccagctgtcccgtctgggaagtgaggagcgcctctgcccggctgccccgtctgggatgtgaggagcgcctctgcccagccgccaccccgtctgggaagtgaggatcgcctctgcctggccgcctcgtctgggaagtgaggagcgcctctgcctggccgctgtgcaatcttccaagcatgaagtgacagcctgtctgcaggggtacccaacagctctgaagagacagcgaccatcgagaacgggccatgatgactatggcagttttgtcaaaaagaaaagggggaaatgtggggaaaagaaagagagatcagattgttactgtgtctgtgtagaaagaagtagacatagcagactccattttgttctgtactaagaaaaatttttctgccttgggatgctgttaatctataaccttacccccaaccacgtgctctctgaaacatgtgctgtgtcaactcagggttaaatggattaagggcggtgcaagatgtgctttgttaaacagatgcttgaaggcagcatgctggtcaagagtcaccaccactccctaatctcaagtacccagggacacagacactgcggaaggccacagggacctctgcctaggaaaaccagagacctttgttcaagtgtttatctgctgaccttctctccactattatcctatgaccctgccacatccccctctccgagaaacacccaagaatgatcaataaatacttcaaaaaaaaaaaaaaaagcaaatcataaaaaaaaaagaatgttgaatattggcccccactctcttctggcttatagagtttctgccgagagatccgctgttagtctgacgggcttccctttgcgtgtaacgggacctttctctctggctgcccttaatattttttctgtcatttcaactttggtgaatccgacaattatgtgccttggagttgctcttctcaaggagtatctttgtggcgttctctgtatttcctgaatttgaatgttggcctgccttgctaggttggggaagttctcctggataatatcctgaagagcgttttccaacttggttccattctccccgtcactttcaggtacaacaatcaaatgtagatttggtcttttcacatagtcccgtatttcttggaggctttgtttgtttctttttattcttttttctctaaacttctcttctcgcttcatttcattcatttgatcttcaatcactgataccctttcttccacttgatcaaatcagctactgaagcttgtgcatatgtcatgtagttcttgtgccatgattttcagctccatcaggtcatttaaggtcttctctatactgtttattctagttagccattcgtctaatctttcttcaaggtttttagcttctttgtgatgggttcgaacatcctcctttagcttggagaagtttgttattaccaatcttctgaagccttcttctctcaactcgtcaaagtcattctccgtccagctttgttccgttgctgacaaggagctgtgttcctctgcaggagaagaggtgctctgatttttagaattttcagcttttctgctctgttttttccccatctttgtggttttatctatctttggtctttgatgatggtgacgtacagatggggttttggtgtggatgtcctttctgtttgttagttttccttctaacagtcaggaccctcagctgcaggtctgctggagtttgctggaggtccactccagaccctgtttgcctgggtatcaccagcggaggctgcagaagagcaaatgttacagaacagcaaatgttgctgcctgatccttcctctggaagcttcgtctcaagaggggcacccggctgtatgaggtgtcagttggcccctactgggaagtgtctcccagttaggctactcgggggttggggacccacttgaggaggctgtctgtctgttctcagatctcaaactctgtaacgggagaaccagtactctcttcaaagctgtcagacagggacgtttaagtctacagaggtttctgctgccttttgttcagctatgccctgcccccagaagtggagtctacagaggcaggcaggcctccttcagctgtggtgggttccacccagttcgagcttcccggccgctttgattacctactcaagcctcagcaatggcggacacccctcccccagcctcgctgccaccttgcagttcgatctcagactgctgtgctagcagtgagcgaggctctataggcgtgggaccctccaagccaggcgtgggatataatctcctagtgtattgtttgctaagaccattggaaaagcacagtattagggtggaagtgtcccaattttccaggtaccatgtgtcacggcttcccttggcttggaaaaggaattccctgacctcttacgcttcctgggtgaggcgatgccccgccctgcttctgctcacagtccgtgggctgcacccactgtccgacaagccccagtgagatgaacccggtacctcagctggaaatgcaaaaatcacccgtcttctgcgtcgctcatgctgggagctgtagactagagctgttcctatttggccatcttggaacctctccgaaatttattttattaaagggactccagtgaaattcatattaaattttacagtacagcaaagagtatttatgatctttaaacttgttttaaaaacaatatgtgcttttggaaaaaagttctagataagaccagataaaatatatatatacattatttaaatcattatttagtaataaaaatacaacaataaaacatatttttataatcatttatgctacatttccaaaatgtttttcaaactgtatcttaatttaaaaactatacacaatatatatgtattatgtagcacatatattaattaactgattcactaaccactatgtaaaaaccatggtgctaggtcaatgcagtagccatgggatagtagaaatagcccaaagatgatacttataagctcatagtctactagagcaatgcagaaaacaaaataaaggtccagttacagtggctcatgcctgtaatagcagcactttggtaggccaaagtgggaagatcatttgcgccaaagaattcaagacaaacctgggcaacatagtgagacccatctctacaaaaaaattaaaccagccaggtgtagtggtgcacacctgtggccccagctacttgggaggctgaggtgggaagatcacttgggctcaggaggttgaggctgtagtgagctgtgattgcaccactgcattccagcctgagcaacacggtaaaccctgtctcaaagaaataaagtaaaataaataaaaatataatgtattaagtaatagccacatatataaattgttacaggtatataacctacaggaaaggccaaacagtattaggtaagtatccaaccttggaagaataagaaaaggtttactaaatgaaggtaaataaataagttagatcttaaattttttgtagatattgccatccctaaaagagaggaaactatgtgaaagaagcagtctttttaaagtgcatttttattttggaaaaacagccagatataactgaaaattcagagatgtgggaaaaaactacaatggaggcaaatctctaaatgcaaaatattgagtcttatgctcttgaaaaaaaaagaggtttggattgaaaaatttatgtttctgaaaaataatctggcaataggtagagattatatgatgtcaagaagtcacccacagcatgaaaaaaaaacaggaggttatagatacaattttatcagaaaattccatgtctagaatgtctattgctatcactatcaatttacttatctttcaaaatctaactctacagtgcttcctacaagaatcattcttgaggtccgaacacagttagcaatcaaaacaaggctgacagatttgtccagtaagaaaacaatgagtaatttttggattcagacagtttattacctacataaacagcaaaagcaagaatagacaaaggtgccagctactagtatcccttgcacaggatgacattgaaacaaaggggccagatgactataacaaagatgtaggacactctgttgcggagaagcccatgccgtgctgcagtaaagcagttttataagctgtagctatgccccaaggagagcaaggcagaaagcccagtgctcgtcggaacctaggaaccaataagaaacgggctcctaactgacttcctaatagactgtgaagtaagtgagaatcaatcttgcatagtcagctgctcataagcctttcatattctcatgttccagaaggatcacaggaaattctgccaagatttagattggctgtagttaagccttgtctatgaagcccaagggcagatatgcaaaattgtcaggccactgtgatgaggctgttctcatagaactatgtacaaccatatcattgtcgtatttattatatcacagtagaaatattttgacctaaattgatgataaaaacatggcataaggccatgcttagaggattagagctaaaaacacacatttgagaaagacttttaaaaaaatcaatgacgtaagcctctaccttaaaatgttagaaaaaagagctgtaaactaaactaaaagtagaaggagataataaatattggcagaaataaaacaggagaaaaaagttaaagagaggctcaacaaagccaaaggttcattctattagaaagataaaccaagaaaaattgagaaaggaataattaatgtctgcaatgaaaggggacctcactacagattcagcagacattaaaagtgtaagatgatttgatgaataccttcacagtaacaaattttaaaaattagataaaaagtttttaagttctacaaaaacataacttactaaggctgacacacataaaaagaaactctgaacgattttagatctatttaaaaagtcatttcaggccaggcgcagtggctcacacccgtaatcccagcactttgggaggccaagacgggtgtggatcacctgagatcaggagttcgacaccagcctggccaacctggtgaaaccctgtctctactaaaaagacaaaaattagctgtgcgtggtggcaggcgcctgtaatcccagctacttgggaggctgaggcaggagaatcacttgaacccgggaggcagaggttgcagtgagctgagatcatgccattgcactccagcctgggcaacagagcaagactctgtctcaaaaaaaaaaaaagtcatttcatttcacaatttacaatcttcccaaaaagaaaactgcaaaccaagattgtttcacgatcaaattctacctaacattagagaacaaaatcacaccaatgcaaatcagctattccaaaaaagaaagttatataaaggaaaagatttaaaatggttgaaaaagtcacgttcttacaatctcacattctcccattttagtcataagaacggaatgattttgattattaaaaacctgacaaattctttaagagaaaaaagatgcaaaattcgaaaaacttttttacatgaggaaatagaataattctaaaaacttcagaattctaaaaaattgagaaacgaaatccactaacatataaaaagagtaatacatcacaacctaactgaaatgtttcgagaaatgcaaggttgtttaacattttaaaatcaatcagtaatggaatataagggaaaaatcatgtgattatcttaaaagatacagaaaaaagcaatatacaattatgaattaaaaaacaaagctcctagcaaaacaggacaaaagaaaacttccttaacttgatctttcttaattgacaaaaaaaaactataaacagcatactgaagggtgaaaaattaaaggcttttgttttgatattggaaataagaattgcctgatacatggtcaacatataaaaattggctatatttacatatttcaataacagaagataaaatttcaaaaaagatgctcattttcaccaaaagataagaatgttcatagcagtagcatctagaactgcacaaactggaagaaaaagaaaaaacaaatatcctttaacattgtacagcctgagtatgccgtatacaaaatgcttgggaccagaagtgtttgaattttggagttgtttggattttgaaatacctgtatcatatacttactggttgagcattcctaatccaaaaatccaaaatctgaaatgctctagcgaacacttcctttgagcatcaaaagtttccatttatttcttttgaaaatgagggtatttataaaagtgaccttccttacttaactattaataaaaatcactaaaacatttcactattatgacttatataaataatgtataatattctacattgaatagagtaacgtataatgcacttgtggcctggcataaagtaaaagcaactaatagtaaataactaccatatgctatttttacttacctcaaggagacctgacaagtacttcacacagatatctagaggctttgtgagaggagagtgtgagctccatcccggaaacgcagtgaggttagccatccctcgtaaggtccgctcaagggacggcaggccatagaaatgaggcgcatccgtcactttcagacactggagcagtttcagagccagctgcgtttgaaaaacgtaaagaagttccgagcatttcctatgtatgcaaaagagggaaaatcaaccaccaagaaagtataatgggcttaatgggctatcttactggctataaaaggttacttaaactcatagtaatagaaaaaaatgaaccagacaaaatggcagaaaatagtctctatcaaaatgagacttttcaaggaaagcataaaataccaactagagaatgtcatataaaatacaagtaacgattacactgggccaggggctgtggctcacccctataatcccagtgccttgggagcctgaggtgggaggattgcttgcggccagcttgagcaacacaacacagtgagacctcatttctaaaaaaatgaaataaaataaaattaaagtaaaaaaaattagccaggtgtggtggtgcacacctatagtcccagctactcaggaagctgaggcaggaggatctcttaagccctggagcttgaggttacagtgaactaagaatgtgtcactgcactccagccggggtgacatagtgagacccccatccctttttaaaaaaaaaaaaaaaaaggttggggggattgctggcaagatggtcaaataggaatagctccagtctgcagctcccggcaagatcgacgcagaaggcgggtgatttctgcatttccaactaaggtacccggttcatctcactgggactggttggacagtgggtgcagggcacagagggcaagctgaagcagggtggagcatcgcctcacctgggaagcgcaaggggtcggggaattttctccaccacccaagggaagccgtgacagactgagcctgaggaactcctgcacagatactgcgcttgtcccacggttttcgcaacctacaaaccaggagattccctcggttgcctaccctaccagagccctaggtttcaagcacaaaactgggcggccatttgggcagacaccaaacaagctgcagtagttcttttttcccataccccagtggcgcctggaacagcagcgagacagaagtgttcactccgctggaaaggggtgctgaagccagggagccaagtggtctggctcagcaggtcccactcccacggagcccagcaaactaagattcactggcttgaaattctcgttgccagcacagcagcagtctgagattgacctgggacgctagagcttggtgaggggacgggcgtccgccattgccgaggcttgagtaggcagttttacactcacagtgtaaactaagccactgggaagttcgaactgggcagagcccactgcagctcaacaaggctgccatggccagattgccagatttcccttgtctgggcagggcatctctgaaaaagtggcagcaaccccagacagggacttatagataaaacccccatctccctgggacagagcacctggagaaaggggaggctgtgggcgcaacttcatcagatttaaacatccctgcctgacgactctgaagagagcagtggacctcccagcacaccgatcaagctctgctaagggtcagactgcctcctcaagtgggtccctgacccccgtgtatcctgacggggagacacctcctagtaggggccaaccgacacttgatacagaagagctctggctggcatctggcaggtgcccctctggaacgaagcttccagaggaaagatcaggcagcaatctttgctgttctgcagcctccgctggcgatacctaggcaaacagggtcgagagtggacctctagcaaactccagcagaccggcagcacatgggcctgtcagaaggaaaactaacaaacagaaaggaacagcacgtccactcaaagatcccaaccgaaggtcaccaagaaaggatatcagtgatagaagatcaaattaatgaaataaaatgtgaagacaagattagagaaaaaagaataaaaaggaacaaacaaaggctccaagaaatatgggactatgtgaaaagaccaaatctatgttcgattggtgtacctgaaagtgacagagagaatggaaccaacttggaaaacactctgcaggatattatccagaagaacttccccaatctagcaagacaggccaacattccaattcaggaaatacagagaccaccacaaagatactcctcaagaatgcataatcatcaagacacataatcatcagatttaccaaagattaaatgaaggaaaaaatgttaagggcagccagagagaaagatcaggttacccacaaagggaagcccatcagactaacagcagatctctcagcagaaacctacaagccagaagagagtgggggccaatattcaacctttctaaagaaaacaattttcaacccagaatttcatatccagccaaactaagcttcataagcaaaggagaaataaaatcttttacagacaagcaaatgctgagagattttgtcaccaccaggcctgccttacaagagctcttgaaggaagcactaaatatggaaaggaaaaaccggtaccagccactgcaaaagcataccaaattgtaaagaacatcgacgctatgaagaaactgcatcaactaatgggcaaaacaaccagctagcatcataatgacaggatcaaattcacacataacaatattaaccttaaatgtaaacgggctaaatgccacaattaaaagacacagactggcaaattggataaagagtcaagacctatcagtgtgctatattcaggagacccatctcacatgcaaaaaacacacatgggctcaaaataaagggatggaggatgatttatcaagcaaatggaaagcaaaaaaaaaaaaaaaaaagcaagagctaccatccttatctctgatacaaaagacttaaaaccaacaaagatcaaaagagaaaaagaagggcactacataatgataaagggatcaatacagcaagaagagctaactatcctaaatatatatgcacccaatacaggagcacccagattcataaagcaagttcttagagacctacaaagagacttagactaccacacaataacagtgggagattttaacaccccactaccaatattagacagatcaacaagacagaaaattaacaaggatattcaggacttgaactcagctcttgaccaagcggacctaataggcatctacagaactcttcaccccaaatcaacagaatatacattcttcttagcacttcatcgcacttattctaaaattgaccacataattggaagtaaaacactcctcagcaaatgcaaaagaacgcaaatcataacaaacagtctttcaaaccacagtgcaatcaaactggaactcaggattaagaaactcactccaaaccgcacaactatatggaaaccgaacaacctgctcctaaatgactactgagcaaataacgaaatgaaggcagaaataaagatgttctttgaaatcaatgagaacgaagacacaatgtaccagaatctctgggacatatttaaagcaaaaaacaaaacaaaacaaaaaaggaaaatttcaggccaatatccctgatgcacactgatactaaatcctcaaagatgttgaataggtatttctccgaagaagatacacaaatagccataagaacatgagaagatgctcaaaattatttttcattggggaaatgcaaataaaaaccaaaatgataccagtctacacccattaggatgctataataacaggtgttggtgaggatatgaagaaaatgaaacactcatacattgctggtgggaatgtaaaatggtatagctgctgtggaaaacagcttggcatttccttgaaaagtcaaacatagagttaccattacagttaccatatgaaccaacaattccactcctaattatatactcaagagaactgaaacacatgtccacacaaaaatctgtatatgagtgtttacagcaacactattcataatagccaaaaggtagaaacagatcaaatgtccaccaatgaatgaatggataaacaaaacatggcatatctataaatagaatattattcagtcatagaaagaagtagtgatatttgctacagtatgcaaggagcttggaaacatgatgctaagtgaagaagctagacgctaaaggtcacattattgtttgatttcatttatgtgatatatccagaataggcaaatccacagacatagaaagaagactagtggctgccagggcccagaggaatgtgtgaatagggagagactttttcatggatacaaggcttctcttggggtgatgataaagttctggaattaggtagtggtgacagttgcaaacattgcggatatactaaaaccattcaaatgtacattttaaaatggttaaaatagtgactttcatcttaatatttttatttttaaaaaacagaattcataactagagatatgtatttgaaagtcatcagtgtaaagataatcataaagtcataggcataggtatgactgctcaagtagatttgtagataattaagagagaaccaggaattaaaccctagagaacaaaactgtgtgtgtgcatatgtgagtgcatgtgtgtagtgaaagagaccaagcaggtacaatcaggctgtaacagattaaactgaaacaaaaacaaacagaacactataactgattattatttaagtatttgaaagaagtatttcttaatttgaaagaagtacaaagtaaaactttgaaaatcaaagaaaacttgggttctatataaatgcacctaaacctgcaatattacaaatggtacctgtcagtaacttccatgaaattgagcagcaaggtatcaaaaagagcaatcagttctttctgaagttgttgcctgacagcagtccggatatcatctgtttcttctcgtgcctgtgactctgtcagaaccaagaggtctaacagtgggtttgcactctaaaaaatgaaatttgtaaaaaatgtatttactaattgaactatatattgtttcctataaagggtttggttgctaagcaagttctagtaagagctatattacctaactagtaggtgtgggcctttactgcattagtagagatgttctaaattcaaaagatgtttaatatattctcaacaaaagaaaaacatatttatcatataaaatagaaaaaaaggacgagaaaaacaaaaccacacataatcatgccacacagaaattgccactattatatattgatatataactctcctttttgtttctgagaatataaacagaattaaaacagtacatttttcacaaacccgtatcaagtgaaaaaaatcactactgtaaccattttttcctacttcccgttattaacaatatttctgcaaaaacattagtttaatatctgattgtttttcaacaataaggatttaccacactaactcctggataatcaatgatgcataatttcactaagctgcaacacacagtgtactcaagttggattttatcttatgtatgaattctgcaataaaattactaaatcaaaatattatagtagttttaattttttgatatatattgccaaattgtccctgtaaaaaatgtaccaatacatacaattacacaggacatgaaaagacccacagcacccaagccagtgctatgtggattattactgcaataatctttgccaccttgataggctagtaaacaaatactagttctttctaaagtttttcctcttttcccaactaaaaaaaaaatagataaaggaatataagaggattatttctaataatattgacaaaagaaaacgttacattaatcagaagcattaatagatatatgggatatttattaatcatctatgatgcctcaggcactgtgctaaaaaaaaaagatagtaagatttcatttgactttttgaataaactagaagatttgcattttcattcctgttttacagatgggaacatagatttataaagaggttaaataattgtctaagtcttagacagacaagggcagagcaagaagcatcttactccaaagctagttaatattccatcctcagcacagtgtcacatcactagtgcatgtaaaaacatacaaaaagagatacaatcaaaatgtaactattgttcttataaaatccttcacctaaaagagctcaactcaaaattaactgcattctctttagggaaaagaaatgaaaatatgtaaagaaacctctaaattgcttatagtatatagagatatatacaattataaataatataactgagagcttttggaaactagtagtgacattttgctcttattttacagtattttaacatctaaatagtttttttcccaactttttcttttatcttaagcaatatatgtctttggataaattaagattgaataagacataactgcaacttttatgtttcatacatgaataaaagaatcgaaatacacatttagtaaatcataaaaataaataaattttctataatgttctgagccctaaatatccaaaagctgactcacattcacgtgccttctgactcccaaaactactgacaaaatgaacaaactgtttataccaagacgcaaactccatcttgtaaaacaattttattattaggaattattaattctgatatgctgataaaaattaagtagaagctactattaatacatgaatatactgaaacagtatgtgtatacctaaaaattaagattctcccaaagaatctcatcctattaataacttgcttccacttgaagattactgaagtttttttttctcttttcacctttgatttacatgttaacactgaaattcagtgaacctcagcaataccacttgtaaaatatagggtgaattaccatttctcaagtacaatagagtagaataagatgtctctactgatgcctacagatgtcaagtgcttaatcatatctgaagtttttgtctttagacgttaggattcaatcctaattttaaaccaactacttgggccattattttgtcactgttgacctctaaaaggcaaccatttctataatgatggctcattttgtttacacacacagttaccactcatcatatccaactttacatccatcagcaagctatgccaaaagtaactgcaagaccctcaataatgtctgagtgcacattgagcccgttacgggaaagccagccaaggaaaatatatatgctgtgtagttctgctgagcttcaccaaaagaagaaaaaaactaacagccccacatttgtgaacttccatcaaaaaaatgcattccaaaaagaaaggtattcaaattcagcacttctaggttactataaacaaaatatcatattaaaaacagattagaggtgcaataaactcctaaattgcctaagaattacaatatgtttgtaataagtgaatgtcttgataaaacacatggaaaaaaatttcacaagagaaagttcctaaatcttccctcgggaagttagctgatttttcttttcacttcctcttagcattcttctgactaatcaggcgttcatatctgcctaattttgtttttgcaaccacaacttttgtatatcttttcatgtatgtccatacattcaaagcaatttacttggaaatgttattttactgagcttcttaaatcatttctcacttattttactcacttcaaaggataaactttaaaaggtacttgattttctatttccaggttccctttatcctaaacattggtagttatataacatatattaatttatcttgtagcataatatttagggagtaaacccaactgatagtgaacacttaagttcacttttgtgcactcttaaaagtagtattatttataacacttgtggtgataatatatgagataaagtagaagctttccgaagaaaggtttaataccatacaaaaccaaataagtaaatgtaactgtaccaaaaatccttttcaaaaactgcattaaaattatagtacaatcatctagagtcttgtaggaatttaattttaatttcataactatgaataaattataaaatatacataaaccttatgacatactacaaaattaacagtacatgtatggtgttacaagtcttaacaaatataacaagactgaaatcatatctaatatcatttctgaccatagtgataaaaaactagaagtcaccaaaagaaggaattctggagtattcacatatacataaaaattaagcaacatgctcctgaacaatcagtgggtcaaagaaaaagctaaaagggaaattttaaaatatcatgagacaaacaaaaatggacaccaaaccaaccaaaacttatgggatacagcaaaagcaggtctaagaaggacatacataacaataaacatctatgtcaaaaagaaagatatcaagtaaacaacctcaaggaactagaaaaagaagcataaatgaagccaaaacttagtaaaaagaaaacaatgaagataagggcagatacaaatgaaatagaaactggaaaaacaatagaaaacagtaacagaatcaagaattgagattttgaaaagatgaacaaaattgacaaacctttagctagactaataaaaaaagaagacaaaatgagaaacgaaaagggaagacattacaacagataccacagaaacacaaggaatcgtaagagactattatgaacaatttcatgtcaacaaattggacaaccaagtggaaaaaattctagacacatagagctaccaagatggaatcatgaagaaacagaaaatctgaacagaccaataataaggagattaaatcagtaatgcaaagtctttcaccaaaaaaaagcccaagacctgattgatggcttcactgctgaattccaccaaacatttaaagaattaatactaatctctgtactcctaaaaccaaatgaagaaggaatacttccaaactcactttatgacggcagcattacactgataccaaagccagacgtgggaactacaagaaaagaaaattacaggctaatatccctgataaacacagatataaaaaatcctttaccaaatactggcaaactgaaaccaagagcacaataaaaagatcactcactataatcaagtggaattcattccagggatgcaaggatggttcaacatacacaaatgcgtaaatgtgatacaccaaattaacagaattaagaacaaaaaccacatgattataccaacagatgcagaaaaagcatttgacaaaattcaacatcctttcataataaaaactctcaataaattaagtagaaaaggaatcccaacacaataaaggccatatatgaaaaacccacagctaacatcattctcaatggtgaaaagtttaaagctttttctctaagatcaggaacaagacaaggatgtctactctcaccatgtctattcaatatggtactggaaatcctagccagagcaattagtatatagaaagaaataaaaggcatccacattagaaaaaaggcaagttaagctgtccctctatgctgatgatataatcttaaatctagaaaaacctagactccaccaaaaaactttgatcttaaaaatgaattcaataaagttgcaggatacaaaatcaacttataaaaaatcagtagcatttctatacagtaaccgcgcccccccaaaaaaaaacctcatttaaaatagctaccaaaaaaaattaagatatttaggaataaatttaatcaaaaggtgaaagatctctacactaatgtccaagttgcaggtaccagaatgaaatcacgctccaaggaaaggggaggggagggaagaggaaaatggaaggaaaaagcaaaggagaaagggaagggagaagggaagggaggaaaagaaaggacaggaaagaagaaatgaaaggagactaacaacccaattgtggcggagaaccagcaaggacatcaagatacaattcatgaaaagaccgaatatgaaaaaatctccatctaattcaaaataagttatctatttataaaaccacaaaaacctcagcacacacgcacctctacaatttgactcagcaattacaattctagaaattcagtctataaatatacttgcatatataagtaaccttgaaagtaatacatggtttccatttttgttaaatcttaactagtgataaaattaaggttttgtgtgcttcttgtaattaactacatagcttattactgagttaataaatgtttattgagagctcactatgtgcaaggcactataataaatgctgggtatgcaataatgaacaaaacagtccctaccttcaccaatctacaataaaggaaaagataattactatggtttgaacattccctccaaaattcatgttgaaatttaatccccaaagtaacagtattgagaggtggggcctttggaggtgactggatcatgaaggccctaccctcatgaatagactaatccattcatggatagtggattaatgggttatcatggaaggggaactgatggctttgtaagaagagaaaaacctgagatagcacatcagcatgctcagccccctcaccacatataccctgcatcacctcgggactcttcagagagtccccactgcaagaaggctctcaccagatatgccctcttaaacctggacttcctgcaccccataactgtaagaaataaattttgttttttataaattacccagcttctgatattatgttaaaaacaacagaaaacagcctaagacgataataaacctctaaataagttttatatacacacaaacattcatatcagttagcatttctgacaacacagtaattcatatttttacataaaattatctctaagtttcgcaaatgtgttaatatataatgaaacatatttgccttataagatccactatgtcctatatcagtttaggccctcttttctagttttgttttgtttttcttcttatttgtgtaaagctttatcttagctaagttgagtaaattcatacggtatttgcaaataaatacataaagagacagatagaccaacaacagggacctggcttcttgggttcttcacacgcttcttagaataagaaatctgaatagccaaaatttttagaatagctatttagaaaaattttagagccaggcacggtggctcacgcctgtaatcccagcactttgagaggccaaggtgggcggatcacctgaggtccggagttcaagacgagcctggccaacatggtgaaaccctgtctctactaaaaatacaaaaattagctgggcgtggtggcaggcacctgtaatcccagctactcaggaggctgaggcaggagaatcatttgaacccaggaggcagaggttgcagtgagccaagatcgcaccattgcattccagcctgggtgacagggcgagacgccgtctcaaaaaaaataaaaaaaaaaaatttagaatttttagaagagctaaaaatctgacagtagtgggggctagaagggtaaatattccagtaaccgttatttaaggcctgaacacactttatctttataactgcaccatcactataccccctcctgcctccatctggctttgttagctaactctcaacatgcctatctggacatccaccctgtcccctgccacctgaactgaaatccccacttaaaaatacagttgcagcagaaagttcacatgcagaacaggttttattaaacacaagactgtaggtcccattcactgtacagaattttaataaacacattcacaatcgtatcaggaaagccatgttgttatgagccattcattacatgaagactactttaccaagcatagacaatataaaattatccttttccataatataatgttaatgatttctacaaataagttatttcccaaacttaaaatccaaattccttaacaccacttacatgtctaagaagtaattcgagaatccagtttagaagttctagtgaagaattttttctttgttcctttattaatttatttaaaaaatgtatgatatctattagcagtttctcatcttcagtgcaagcaggaagcacctgtaaaaacctataatgaaaagacaataatcatggtttctggcgctttaaaatacacaataccactgttcatcatagatatgtggacttaacagatgtcttgtgaggatgctattttatgagacactgttttaaatgctttggaaaatgcaaagttgaaacaaactgggtatctgccttcaagaacatgagcttatagtggaaaaaacatgtggacaagtaactaaaataactagaagtgacaaatatcataagagaaaaataacaaattcagaaaaagtaccaaaaaaataccaaggggaaaaacactgactctaataaccgcccagtgaaacttgcttttcatactgggaatgtcatgtttcactgatgagaagaattagtacttcaaacctaattctgaccaactcgaaaaaataaggtaataaagtgagggggaaaaaaaggcctgcaaggacgctactagagtttgtaacaggcaaggaaaacactgaaggtagacttaggatgaaatttctttttaagttcagagcaaaaggatatgagccaattttctaagatttctttaaaaaaaaaaactggtttaagagagctaaaagattagtagacaataaaacttttatttaaaagggagaagtagtttggaaatcgttttttttaaaaagcaatcagcaagagatatgagatccaattttatctgtaatgttttattttttataaatctaaagccattgcatcaaaatgttaataagagtgacaataatacgaatcttaatactcagcatttatggagcaccaaccttgtgccagcctatgttctaacagcagggtttctgtcaaacttcataacaacattatgaagtaggcacctctatttcaaagacaagaagacccaagcaaaaatatggttaagtcgtttttccacagtcacacggctagcaagttttaaaacaggaatactaaactaagcagtccaacaccagggatatataatgctgtatttcttagtaatgtggtgtttgtctcattattatttttccttacttaaaattctcacatccccaaaatgacattcagctgagtaggatggcaagtgccggattatgaaaattgagaggtgattctaacaaccatagatctttgggagatttatgatttaacaatcacaaagattataagaagtcttctatgatatccagtgtaacattaaaatatcacctctgtaaccccattttataaccaccctcatatcccctaaatctaagtgtactatcctcttttcaattcctcttgaagacacaagacactctttcctaactcagggcctatccctttgcctggcatttaaaaaaaaaattaatttgtataatatttgttgaatatggcattttagtctagaggagaaataatatattctgcaagtggttgtgagtcaactgaccatccatttacggattcaaagtatcaaatttctgtcacataacatgcaccaaactatattccatttatttgttttatttttaactgacaaataataattgtatgtatctttaggatacaatgtggtgttctgacacatgtatacattgtggaatgatccaatcaggctaattaacataccaatcacctcaaatacttatttctctgtggtgagaacatttaacatctattcttttagctattttgaaacatatattattattaactatagtcactatgctgtaagagatcaccagaactcattcctcttgtctaactggaattttgtaacctctcagcaacgtctcccttttccctacccatatccacctgccacttgcctctggtaacaattctactctacttctttgaattcgacttttttagattccatatataagacagatcatgtggtatttgtttctctgtgtgcctggtatcttttcggcttccaatcccatagacttttaacatccttctacctgttatgccttggcttaagcttcattctctgaaccactttctctctactgaagagggatagggtgctcctctaatgcagtttcctaatagtctgcttggaagcatttctacttttgattatacttttagctgtcttaattccaagttccatgagagcaggaccctatcagttttgcccactgctatatttcctacaagagtgacacctagtaggtgatcaataaatgtttgttgaatgatggaaaagcagtaggaaaagaaaggcagtagcccctttcttcctattcaccccatgccacagcaccacacccatataaggtatcatgtccagatctcagggagagtcctaagaaacacaatacccttgtaaaatagcatgaacaaatgagaagtctggacactgtggcttttaaagtctatctaaaaaaaaaaacaaatcatttaaagcagggtggggggaatagagaagaaattatagttatgtttaaatgaagagctgtcacatgtgaagacattatttattctgtgagtttaaaggacagaataacaggtagaaatgatcaggtacagtctaaaagaacaaaaaacttacgaataatcacagcgcaaaaacagaatgaatatccttcaaaggaggtgttcacgctgaggctgcatggccaactgtatactatgacttatgcgatatgtgagggatataaaaaggaatgtaataaacccaaggcacatgagaaaacaaatatttaaacaactgtagaagtaatgcaggaaagccacatgacaatcagggtaactagaattccacatacatcacagagtaagaagaccctggagctcaaggaagagtagatattcacaaggcagccaaggagttaactatgtaaaagcaaggatgtataaaacagaagtgtatgccctaaaatatcaagcagtttcataaaaccccaatatttgcacttcatagaaacacagcatatgttagagagagaggaggaaactgtagctgaaaaggtaagcaagagctagatcaaaaagaactttctacagcatgctaaggggttggaattctattaatatctagcacaccatggaagagaacccacaggtgacatgtatttcagaaggatcattcaggaagcaacataaatgagtggcataaggttaaaagcagaaaaaccaattcgctagtcagtctacagtctggtgaaaaatggagaaaaacagtagcaataggacttccagtaggaaaggagtagagaggcattaaacatgcaaactcaacagaaactagttgaaagaagactctagatacctctgacaacttgtaatcctactaaaccatgactatcatctgttttcttaaaataagtttccaaaatgatattagattataattgtatgcttgtgtgttagcatacacatataaaaacatacacataaattaatgttgggctgttaaaataatcatcttggaaagttatgtttagaagccacagtaccgtaagtaaaaagattttagaaaccatgttttttgtcaaactgaaatatacttttgttaatagtgataaatagtcatggtttagggtggtgttcatttcggtatacatgtaaaaatcatttttacccttctctggatagttgagtttgctaatatcattttttagtaaaaaattaaatataacttcaaaatataataagacttccttacatctgctgtttaaatgacctgagaggacaatttcaaaatatctgagcaaagccagaattattctaacatacacactcactcctaaaaggacctcttttgcggaacattcatttggatatatcatatatttgaaaaattagcctcaaagtatatttactgacatggaaaatgtgtaaaaaataacattatttttaaaatacaataaaaaaccattcacacaggtatgaacatgcttctctatattttgttttgtctagaatgatataatttgaaatagctgtattttaaaaatattaaactaagcttataaaaatgttctcaatatctcaatactttatacagccatgatttatgggaatcttctatctccaagcaccctttaagctgttggttcatcttagataatcagtcaaaaagataatgttcctttctatcattaaactgaatgaaagcaaaactaaagtttcccaaagcctcattagtacatacattgctggaagtaaagtttttaaaaagttttcatgaaaaaaggtggattctgtgatatatatttttgatacattccttagtgaaacataatacagcagaaatacatgaatatttataaattaggcagtagtgtctgtgttgccatgatcaaacacaggcctaaaaaccaaatacaagatgaatattatatatgcatgtgtgtatatattaaacatatacacagtctatactctccacttacactagtcctgaggaaactaaccataaaaaatgtgatgctcacatacagttactgctattgggcaatttgaaatactctaaaggcttccactgacccacagtttgagagtctttcctgtaatgtggtattgcatactatttctatggttttaattcacaagagaaagaaaacttagtgcaatgaattcaatcagcttttatgttaaaatttcttttgacaaatagggacatattacatttatttaaagtgaaggatttatgcattcttcaactggcgagactgtttaaatgcgggagtgtgctgataaatatgtaactgagagtgctgacttattgtgtttgtcaatttccatggtgtaaatatactactgtagacaatgtggagctaccatgtaacatgaagttgtgaagagatgcacagtggtactccattgtagttatttccataaaatacatacccctgtagtgcatatgtatgcataacctcaagaacaaagataacagtaaaatgttgccacataattagaaagtgatgtttgcatattcattaccttttgtcttcatataatttatttaattgtaagtttatataattaagaatggctgtgtttaacaatcaccttacaaaaatcctgaaaattcaaccatcagctctctcacaaggctgcattagtgggcaccagcacaccactggaaagcctaatcagataaactaatttttaaagctaaactaataaaggaattcatattttggaaactcatttaacctagcagcttaaaaactgcacattttatgttaaataataaagttatacattttatactaaagtcacatgaagaataaaatgaaaacctgcttgcagtggttgcttatcagtcttgttgcaaatgcaaccatctgctacaagttaagcatgttaaattgacaagctagagccttctcaattaactgctataaaggaccgccacatggcaatcaacttcatgaaattgagagtaaaaagaaaaatgatataatttacttaagaacaaaacaaaagcaaaacaaaacagcctgtggcaggtgtatcacagctattaatcaattcactgatgtctcaactcatttataacatggatagaaataaacattcaatttgtttcatccatgtcttatcctaattatttgcttttgtgaggtaaaattttctaagaataaattgttacaagtttattaataatcccttcaacaatgcaataactaaattaaaaatttctctttggctattattacagatgataaaaatcctggagtttttctttctatgatagcagcagtaagggcatagactcttatcttcaaaggttaggagatgaacacaatacaatgcaatccaggtctttgaaactggcagccttgaccttacactgacctgtttagtgcggtgtgccaagccaaggacttcaaggtaaccccacatggaccagggcaaccctttaaagacaatctgtcattcagaagataaaaactcatcctggtgacagcagccctaacttccctgtgggttgcagcctgaacaatggaatggaggcagtcctgcagcccactagccatgtgtgttatcttcagagtgaggatgtcctctgtagataacttcaatgcatctaaaattctagacaaaaagaaaaaaaatgaaggaggaacataaagctatttaaataaaagctcacacttatttctattataaactctcccaaaagctgttttatcttcattttcttttaacaaaaggttgacttacagccagaagaaaaactgatacatatctgtcaatattaggattttacattggcatcccaaatgtttatattgacttttcctccttataaaaatttttattcacttaagacagacagattagaatattaagatattcaaaagtaatcaccatcacactaatgataacactcatgcatatacttactgagattttgttctaatccaggacccttttcctagtgattcatatctacgaacaaatcagactttaacctctaaaacagtacagagtaaaatgctttttcatttaaagttttcccatatgatagattgttaaaagtaataaacacatgtaatatttaaaagaaagtaaaaattataactgttaaaaagcagaatcagatgataccaagggaaaaagctactggacctaaggaaaaagtaaaacttaactaattaattacaattaattaattgcaaatgctttttaaactaatataagagcttactcttgcgttttagtttcagagttcatttgcttcaacagattatcactcccatgataccatgacaggttccaagctattctcagcatatctgacaccggcttcaaggccaaacaatcagcagataagggcaaaactatggagtaaggactcacagcatggtgtccaattacatgaacaggtagatggtacctaaagaaaatgtgtacaaataattacaaactttcaaattcttaaatgctactcaaaaagatgagccacaaatgagggctagttcaatgcctcccaacccacaataatgcaaaggtttctcttagtccctattttaaacaattatcataatttatacagtatttcaattattcttttcatctcctctaaactccccagaacacttaaatcctttcttgaggacttaccacattctatgctatattagagttgttgtggagataactaatgctccttgaagtcagggaccatgaatacagtgaaccaaacataaaaggtgttcagctaaaacactgatatttactttatgccaaacactgcttattttgtatcattcattcacagttacatggtatggcactatgatacctattttacaaatgatcaaaaatgaggcttaaagctgataaatgaattgcctatgatcatagaggtcactaaatgactgaattccagcttattgttttcacttgagaacatggtttcatcatcaataaattcaacaagaaccaagaaatatgtttagaaataaaaacagattcaatagcagtatcttttaaaccaaagttaattttgttctaccgtaaagacacatgcatgtgtattttgtctcaagtttttcctttaacatggtgaaataatctaacatgcatgtaaatttgcatcctaaaaggaacaaaaagaaattttaaaactcctaaaatgtatatggaacaaaacatggtcctaaatagccaaaacaatcccgagcaaaaagaacaaagagggaggtatcacactgcctaactctgaattatgctacaaagctatagtaaccaaaacagcatgatactagcataaaaacagacacacagaccaataaaacagaataaagaatgcacaaataaatacacacatttggtcaattttcaacaaaagcaccgagaacataatttggggaaagaacagtctcttcaatgaatggtactcagaaaactggatatccatatgcagaaaaatgaaactagatctctatctctcgccacatatgaaaatcaaatcaaaatgaattaaagacttaatgtaagacctgcaactatgaaactactagaagaaaacattagagaaatgcttcaggacattagcctgggcaaagatttattaagtaagacctcaaaaacacaggcaagcaaagcaaaaataagtaaatgggatcatatcaagctaaaaagcttctgcatagcaaaggaaacagtcaacaaagtgaagagaccacctatggaatgagagaaaacacttgcaaactattcaactggcaagagattaaccatcaaaatatataaggaactcaaacaacttaacagcaaaataataataataataatccaattaaaagctgggcaaaagatctgaatagaaacttcttaaaagacatacaaatgaccaacaggtatatgaaaaaattctcaacattaccaatcatcagagaaatgcaaatcaaaaccacaatgagatatctcaccccagttaaaaaggcttttatcaacaagacaaaaaaaaataacagatgctggcaaagatgtggaggaaggagaatgctcacacactgttagtgggaatgtaaattagtagagtcattattggaaacagtatggagttcctcaaaaaactaaaaacagaacctacatatgatccaacaatcccactgctgggtatatatccaaaagaaaggaaattggtatgtcaaagagatatatgcactcccatgtttattgtagcactattcacaataaccaagatatggaatctacctaagtgtccatcaatagatgaatggattttttaaaatgtggtataaatacacaatggagtatcattcagatgtaaaaaagaatgaaatcctgtcacttgaaacaacatggatggaactggaagtcattacgttaactgaaataatccaggcacagaaaaacaaacatcacatgttctcctttatatgtgggagctaaaaaaaaaaaaaaatgatctcatggagataaagagtagaatgatgattaccacaggctgtaaaggatggtggggaaggggggaattaagaagggatggctaatgggtacataaaaatttagatagaaggaataagatctagtgttcagtagcacaatagggtaaaaatagttaacagtaatttgttgtatatttcaaaataactagaagagcagatctgaaatgttcctaacacagagaatcaataaatgttagaggtaatggacatcctaattactctgatttgatcattatacattgtatgcttatatcaaaatatcacatgtactccataaatatgtactattatatacccataaaaataaaataaactcccccaaataaataagcaagcaagcaaagtgctgtgggatatagctgaaggaactcctaagagaatggggaacacagttccttcaaagaagcaacaataaaactgacagccaatgttcctacaaaaaaatggactccaactgccaacctagaattctatacctagtgataacattttttaaaacagaaagaatttttagattaaaaaaaaaaaaaacctgacagaaatcattgctaatataagtgcactacattaaataataaaaaactcttaaaaaaacaaattctcagatggaggcagaaaaaccaaaaaagcaataaaaagtaacagaaacgaccacggtatacaaatctaaatgactatttactgcataaaataattataataacatcttatagaatttaaaatatgtatagaatttaaatacctgacaataaaagaaaaaaaaaagaagagcaaataaatggaattaatgtgttctaaggtccttgcattgtctgggatgtggtaaaaatactagttcacagtcaaggaagtaaattataatctctatattataaaagaataatcatctgtataaaatatatagaaataatgtatatagaagaatacttagctgggcacagtgactcatgcctgtaatcccaacacttttgggaggctgaggtgggagaattgcttgaagccaggagttcaagactagcctgggcaacaaagcaagatcccaatcgctacaaataaataaataaataaaatacttaatgtatatgtaactacaagttaacagctggaaaacatggactaattttaaaaattaatcaagaaaagccagagaggaaaaagaaagaaaaaaaccacattggacaaatagaaaatagcaagctaataatctgtatccaaaaatattagtaattatagtaaatgtaaaatgcattaaaatattccattaaaactgtaaataatgtcagattggacaaaaaaactcaactatatacttcttaaaaaaaaaaagtacatttaaggacacagaacagctaaaactacaaggatggaaaaatacatatcatgctaaccactaaccaaataaaagctggggaagctacagtcataagagatcgagtgaattctatatgatgaagcactgctagagataaagaaataatttcataatgatagagacaacccaccagcatgtttacaaactaaattacatggcctcaaaatacattgtcagccagaatgacaatgtcatagtggagattttaacatgcctctctgctacctgaaagaacttcacacacatataataaagtagacacagggaagatctgaacactatcaataaacctgatatattttgagacttatagaacagtatatccaacaactactacatatacattattattttcaagtacacatggaacattttaaaaagctgaccatatgctgggccataaagtaaaattcaacaaactctaaagaattaaaatcatagaaaatattttctaatgtcaatatttagctaaatattaataataaaataactagaaaacctaataaactaaatcttcactagttacccccaataactctaaacaacccttgcatcaataaaaaaaaatcacaaaacacttagaaaatattttgaactaaataataaaatatggcatatcaaattcgtggaatataccaaaagccatacttagaaacattgatagctttaaatgaaagggcggctaataatcaatggccaatcctccagtaagttagaaaatgaacagaaaattaagtttgaaaaacacagaaggaagaaaataataaaaagcaaagagtaatacatcaggaccactttgagatacactatacatccatcagatgggcaacaattttttaaatgccaacattactgtgagtaaaagagtaataaaaccctttctcctctttacggacaaacatgatattgaggtaactctctgtccctttacccagtaaaatcagatagatatggaatgtcaagaatttactaagctgctttgcttatgatgaaaatgactccccacatctggactgagacatctaggaataaactataaatgcatgatgggatgtcacagctctgagcaatcttgagtgctgtggctcttataagcaacctggaaactatgcctacagcacacttactagagaacatattttctatttgggacatgaggcttccaagccaagacagctcccagcacccacaaatgtgatctcattctaagcatgactactgcagtcgtgtgagtttcattatttagccaaactaaacaccattaagactggtaatgcaaataccaaaggctagtgaggatgtggggcagctagtacttttccactgatggtaggaatgtaaatcagcacaacaacttcgtaatactgtctggtaacatctactaaagctaaacataaatatcctatattccaacaatgacacgtgttcaagaatgttcttagcagtcatttcttcataatagcccaaaacagaaaacaaattaaacatccacaaatagaatggtaaataaaagtgttgtatattcttagacagaatactacatagaataaaaatgaaccaactattgattgcttcatgcagcaacatggacaaatctctccaagttgagcaaaaagcaatataataatgcactctatttataaagttcaaaaactagcaaaaataatgtacagcaatagaaattaaaataggattacattttggggtggtagaaggtaatgagaaagcacaaaaagggtttccggtctgtcagtaatattctatgtcaatctgtgtgagataaataagtacgtttactcagaaaaattcaagggctgtacccttatgacttgtatgctttatgtacgatatatgtcaataaaaacaatttactttttacaaaagtctaaagagacatgaaaaccaaatacaatgcagaaccttaactggttattgcattctgaaaaaatatacacaaaagatacttggagataactggagaaaccacaccatgttatagaattatttttaatcttgttagatgggatcatattgtagcagttatgtagaataatgtccttaacttaaggatgtgcatgctggaatatataggaaaggagtgaatttatgtctgaaacttatttccaattggtgggtgagggagaattaaatataaataaaaatatatattaggagagagaaagcaaagagactcatatgtaaataattgatgactctaggctgaacgacatacaagtatgcaccgtatagctttcaactttcctgtaaatttgaacggtatcaaaataaaaaattggtggtggggagatatacttactgaaatcttcaaagcaccattgtgaaggaaccatgaaagcccaagttatgggatttaaatgctaaatgaaaattgtgacaaattatagattttgatttccctttctgtaacaacatttcgtccttcaagaaaatcagagaaataaatcctttaccttctaaaaacggaaacaggcaaactgaagaccgatggcaaagaaggtttattggaaggattaacagacctatttcataaaagaaaaacaaaaacaaagaaacaactgagtagaccaagttttgtctaacaaatacaacttacctcacttcgttgactgcaaatgaaatcaagcagtgcaactgagtctatcatttagtatagaaacaacatgtttgctacttcctagatttgcttatgaagagtaaattatgttttaaaaaaaaattccacataacaaatgattcatacaatgcagtggtgggactagcaggtggactttgtgcgtctcctcccacggatcctgctcaagatcagcgctaatcatatactatcgtcctaaatatcttccgaggttttttaaaaatcatgaaatattaagaaaaaaacacatagttgaaggtatgtactaaaaatgtattaaagacaaaaattactgcagtaattttaaagtttatatttagtaatgtttaaaaataaaatttgagatagactttctgagctaataggcttttgaatactgtttattcaaatcaaaattcataccacatatgtgtagcatggacagcataagcttcgtaaatcagaaatttccatgccttgctataagattacatcagatacctgagataaatagttaagagtaaaaaacttataaattcttatatctcaccacatatccattctcgatacttcatcaaataatagaagacaaaatagtgctccaacttcagtcacgacactacaatcttcatgaaatattaaggaaactgaataaaaagaagcacaactttatgaaatatttgtacgtctagaaagaatgaacttcaaatttaaaatatcttgatttgaagagaaaagaaatgcaacataaacccagataaggtgacactaaaacacaggctttcatctcaaacttgtggatgtacaagaatcacctggaaggctggttaaaacagtttctgattggataggtttagggtggagcctgtgaatgtgaatttctaataagttctcagaggatgcagatgctgccagtccaggagccacacttgtagatacactcactagacactgtctagtcttaggtaattagagaaacaaactgatacagcctctaagaaggttatgccgagtcagataattctagctaaagtttcctcaccaagagatcttattttataacttttgccctttactacaaacatgtgatcacagaacttggatttgactttaaaatgttatccttgggctgtgtcattgttttggttccttttaattatgacaagatgatggaaaagggaagtgctctgaatggacagacttaacactagctctaccacttactacttagctaaatgccctggtgagattctttaacattaagtctcagttcccacttctgtaatgatcccaatgctacaatctccttgaaacctatgaaattctaaacaaagaagtacgatgttatctcacaggaataacaacataatacacagttagcaaattcagggaagcagcaataagaagttttgagagaagagatttttcctaactgcaggaaaagaaaatcatccttatgtaattggcatgattaaaaatagccataaaccaaaaagtaaagaaacagagaacatgtaaaaattaacttataataaaagacatttcacatcagtgatgaatagaatgaaccataatatttccaaataaataagaattacagcaatgcctttgcctgatttcaaatttaatttttttaaacaacacttgaaacacaggaaaagtgttttcaatctggaactagagaaagtcctacttgaagagcatgataaaaaattgcccaactgccataacagaaaagttctatatgtttccataaaatatttaagtttaaggttaaaaatataataataaataaatttaaaggatagaaaagttgagagaaaatattaatcacataaaatcaagcataaggattgtgcctatcttataataaaaaaccctacaagtcactaaaaagaaagtaaatacaacaggaaaataagtaatccatagatgaagaaatttgaatatatatgaaaagataacttcactaaaactaaaataagaaaataaaacaattatatatttttacctataagattaaaaaaaattaatgagacatattcagtgttggcaaagttgtaatgaaaataagcatttttaaacacctttggtgagagtgatttggaaaggaacttaaccattatcttataaaatctctttgacctaggaattccaacactgaatgcacaaagatgatcacacaacatgattactgtcatggtgaaaaatctaaaacaaatacccagtaacatagcaaactgaaattctgcaacaccagtgcagtagtttttagggttttttaaagaatgtatactcacatgaaataatatagaaagatattcaagttacatttccagttgaaaaaaggaagcaacacaatactgtaatatacagaatgaaaactacatgtgtatgtagaaaaaatcattcggaaaaatatattcctaatgataaccagaacagtcttctttggggaaattgagaacgagaagaaaatgaaaacttttagaatttgtatagttctatattgcctgaatttttacaatggggatgtataggtctgtgattatttaaaacagaaacaaacaaaggtaaggaagtttcgattctctctcagtagcaaagtaaataacccaataaccattttttggttatagccttggccaagttgctaaatctctctagacctcacacagatggtatagtaaatgatttctaagttaatttctaaccctgaaatacactatagaattctgtcataacataaagtttataattcaaagcagtgttatctgagaagttatttattgtactcatttgatccactatccatgctacagaaataatcttcctaaaacacatactcccctgtttaacaaccttaaacagctcttcactgctgtttaataaaatctcccaggccctgcacgaactgccctccctgcctcatcccatcatttccccttcactccacactccccaaatccagccagctccatctcaaacacatcaatttctcatacacacaaccacggctccatctagaagtcaatcttgcctatttgaactcctactcatttctgaaattccatcttagatgccacattccctagaaacaatctctgatacttttcaccaaccaatctgaccagcatgtcctctggcaccaggaatccccaattacaagtattactgtggtgtactgtatatttacttgtcaatgtctccaactctactgtaagctccatgagggtcatttaccatgctcaccaatataacccaagggcctagcattgcacctagcacaaagcatgtgcttaataaacgtttgctgagaaatgggttttcttggttaagcagctggttaaaaattaatttttcggccaggcacagtggctcacgactgtaatcccagcactttgggaggccaaggcaggtggatcacatgaggtcaggagttcgagaccagcctggccaacatggagaaacctagcctctactaaaaatacaaaaattacccaggcatggtggcaggcacctgtaatcccagctactcaggaggctgaggcaggagaaatgcttgaacccaggaggcagaggttgcactgagccgagattgtgccactgcactccagcctgggtgataagagtgaaattctttctcaataaataaataagtaagtaagtaaaatttttcctgaaactaaatccattaatggaggatactatattcattctcaaactcattgaaagtaatttccacaaacagcaatgaaatagaaaaactgaaatactgaaaagggtatagattatattgccttgaaatgtgcttttgaatccagtaggtgttcataataagttccatgcttgaataatttaaatgaaaattataaatgaaaaggtaaaccaggaactaaattcaagtgaatgaggttaataagaagacaattattaacaggattaaagaaaactaaaaatccgtaactgctgctctttcagatgatcagtctatacaatcttataaaaacgttatagtccactcaaaatgttatgagcctaaacacactgaatctgtttagagctttacctggttttagggctgctacttaaataaactgcatcttactcacttggcaagcagaagccaacaggaggaaaagatgctaaaataaaatgactacattataataacatattttgaacataaatctcacttatctcctatatgcctgataatagacaagatgaagcacattcagatgcttgtacgtgactcttcagcacattcagatgattctacatgactcttgcaaaatatcaaaaagcagtggcctaagtctctaagaaaaaaaatagtacaaaatgttaccaagctctccattgagaaaaaaaaaaaaacagagaagacaggaaggacaaaactacatgaaacgtgttcatctaacaccttactaaattagaatcaaattaaaatgggtttttaaaaaccacattttatagaatgtaataaatttaggctcagagtcatttaggatggtctagtttctactcacacaggttgagcctatactcttaacacctgtcaaatgaaataatcagacaaaatgtaccaagatccaaaggtataagcaaaacaagaaagacgaaagagatattggaaagaagatagtaataacagcagctgcaactttctctctttatagataatagtttactgtctgagcaccagatgacatctacatcaaggcacaaagaacaatcagaggtttcagcttttctcagctctagcctccactcagcaacaggattagaaagcaatttccacaaaaatattaaacattttccatttacattagtagtgtattcactaataaatgctgttgttctaatagtaaaataaaaagtaaatgtgacttacaattaaagaagaaacacttaaaatttaagaacaatctaattattagcagattttcttttatttacctctgaataacacggtcaaaagagaagactgttgcgagagcgaaacacgcatgactggatcaccacataaaaccttcctcaagagtgtgaggcatggttgtaccaaacattctacaacctgggccaggaggaaaaacacagcttttcattttcaccaattatcaggtgagatcaaacagaccataatattatcttactctaaattttatgcgttttcatcaaaattatctgaaactaaaatgtaaataaatactaggaattactttccactgaaagtaagtttcgtatatacttctatcacctatcttatggaaattttaggattagttttcctttatagagactccacttttcgaatttaaaaaaaaaaaatgaatgagataggaggtgttacttagaatttaaaatccaagtactcatccaaattctgctcagttcaatttcagatctgattaatcaaaacagcctgtaaaacaatgtctagatgcacattagccttaccttgccatcttgactcacacattcatttaaatactcaattattttgtcaattaagcataactttttcaccacagcatgcattttaatatctgtagataaaaaaagttactaaaagttaaagcacattttttgtagtttaaaacacgtattttgaaatactcagaactgatatccacacaaccttcaaactattaaaaatacttagacctggggttgacataagagtatgaaacttttaactttttactttacgtacacctgtccaatttgaaaatgtttaagtaaaaagcatatcttacttctgtcacataaaatacaaaactataaaaaaagaattatggaactagttcagactctgaaaactacgagaatttaagtgtacaaatgaatgcttatatttatacatgcaaattatcttctttatattatttcattgactcttccaaatttatcaccttcaaatgtttataattctccacaagctcatgtgtaaaatatgacttacaacatgaacatttttctatctataaaaaaatctctaacctcaaactattaatagcaaatataaaaggaacaagattataatacactatatatttctggagaacttgagcttctttttaataagcatatattcacatattatgtttgtaataaagaagtttttgtatatacataaaaaaatcttatatgtatagacatgtgcacacgcacacacaaatgttaccggaacccaaaactgtaattgattatatattcgttacaagtatttaacaacttgcagacaaattttctcctatattctcattaggaaaaacacatacactcacatactgatattgaagtggaagctatcattgtaacaatctttagctgctacttaaaaaaaaaaatttccattgccccccaatatagtgcataccaaaattataaggcatacttttgaaatgttaacaatattgaaggaatactctttaacgagtttttcttgatcttttttttaaccagggctttccacattttctagtcttcttttctgtagtctgtgtgattgttgttaaaactaaaaatatgtggaatatgttttttcaaataactctctcattccagtttccactaatgtcaagacaagaagtgctaaccataaaaatctttttacataaactcaaagttatcatttctcataaatattaaagtacatacatcacgtatggggaaaaattcaaaactaacccaaagaacaaaagcctatggaataacaacactacaaacaaagctaacagtgtattacactagttgtttttaaaaataaacatttatacaccatggaatactatgcagccataaaaaaggatgagttcacatcctttgcagggacatggatgaagctggaaaccatcattctcagcaaactatcacaaagacagaaaaccaaacaccgcatgttctcactcacaggtgggaactgaacaatgagatcacttggacacagggcggggaacatcacactcccgggcctgtcacagagttgggggttgggggagggatagcattaggagaaatacctaatataaatgagttgatgggtgcagcaaaccaacatggcacatgtatacctatgtatcaaacctgcacattgtgcacatgtaccctagaacttaaagtataatttaaaaaaataaaaataaacgtttaaagaaaaggcatagctacagtgtactatttttcttttacctaccacaaaagtattatttgattaatttccctaagcaagatggtacagattgaaaatatgatgcatgcactcagtaaacagaggaaggaacatgcacttcactattggaagtacactaatattttagaaagaagataattctatcaaatggcattttacaggtcaaataataataaggcattagcaaacttcttctgtaaagaaccaggttagtaagcatgttgttaggctttgctagacacacacatatggtctctcgcatattctttggttttggttggattttgttaacaactctaaagatgcaaaaaccattcttgagggctgtcaaaaaaaaggccacaggctggatctggcgcataaaccatagttgccaactcctgccagtaccatatggcaatctaaaattctattatcagcagtacagcaatcatttcccttaaaagacattaccttgcataatcacagctaactgttcagcagctgactttctcaaaacgagatcaacatcatctgaggtgaagatttcatataccttttcaacagtctccaactacaaaccaaaaaaaaaaaaaaaccaaaattacatttatctgcttccaattctccaataagattttatagtttgtgccctatgaacaaaagctcaaaaagtcaacttatttaaataaccaacataattacaggtaaattcacacaatgctgggttaagtagcagttctgtatttaggtcttcaaggaattgccacactgcttttcacaatggttgaactaatttacacagtcatcaacagtgtgtaagtattcccttttctccacaacctcaccagtatctgctattttttgacttttaataatagccattctggccgggtgcgatggctcacgcctataatcccagcactctgggaagctgaggtgggcagatcatctgaggtcaggagttcaagacaagcctggccaacatggtgaaaccccatctctactagaaacacaaaaggccaacattgtgaaactccatctctactaaaaatacaaaaattagctgggtgtggtagtacacacctgtaatcccagctactcgggaggctgagacaggagaatcgcttgaacccaggaggcggaggcggcagtgatccaagatcgcaccactgcactccaacctgggcaacaagagtgaaactctgtctcacaaaaaaaataaataaatagccattctgactggtgtgagatggtccctcgtagcagttttgatttgcatttctccaatgatcagtgatattgagctcttttccatatgccttttggccacatgtatgtcttcttttgaaaaatgtctgttctgtcctttgtccactttttaatggagctgtttggtttttttttgtaaatctgtttaagttccttatagatgttggatactcaaatacaaatcattctaccataaagacacatgcatgtgtatgttcactgcagcactattcacaacagcaaacacatggaatcaacctacatgcctatcaatggcagattggataaagaaaatgtggtacatatacaccatagagtaccatgcagccctaaaaaaggacgagatcatgtcttttgagggaacatggatgaagccggaggccattatccttagcaaaataacacaggaacagaaaaccaaatactgcatgttctcacttataagcaggagctaaatgatgaaaacacaaggacacaaagaggggaacaacggacactggggcctgcctgagggtggggggtaggaggcgggagaggatctgaaaaataactatcgggtactaggcttagtaccagggtgacgaaataatctgtacaacaaacccccatgacacgagtttacctatataacaaacccgcacaggtacccctgaaactgaaataaaagtttaaaataaatacataaataaataaaatttgcaacaatgatgcagtaggtcaggaaggaacttaagatctaaaataaagagtcatcatgtcaaataagttttccttttttttttttgttttttgagacagggtctcactctggtcacccaggctggagtaaagtggtgcaatctcagctcactgcagactcgacttcctgggctcaggtgattctcctacctcagcctcccaagttgctgggactacaggcatgcaccaccaaccccagctaattttttgtatttttagtagagacagggtttcaccatattgcctaggctgggctcaagtggtccacccatctcagcctcccatagtgctgggattacaggcaagagccactgtgcccggcccctctcttcttaatatacatttttgctaggaagttattcataacccattaatccattagcaaccttacaaaggtaacagaaaacaaccatgttccctaacatctttacaggtagtaccaggctaacctgagaaaagcgacccagacctatgactcaagatttccctgttgctcccagaagccaccagctggtattcccgtgggcctctccattctttcttttagaagaccccagagcaaacagcactctgggacttgctgtccagcaccccttcaaagctaccccccagacaagtcccttactgtcacttcatgctagaacagaatctgaggtggcaaaaccagcatcaggaaaaagggacaagaaaataacaaagatgaagctcctttctcccactcactgctatcttccagtcctaacatggactcacagaagacgtattagaatgccctctccccgccttcctccatacatcagggcacaggagtgactaccaatggcttagtactcagggaagtcccaaccagacctggtatgtggccagtgaagactctccaatccccctgccagcactgtcataaagccctgaacattcagtttagaagaacataatgtgtttccccattaaaaagcaaacaaacaaacaaaaaaaccgactgtattacatgtggctctaccatactactacaggccttggcaagttagtctaaaataaaacagacagattgcaaacttgagtgaaatgagaaagtacaaaacacaggaatgaatccatgaaaacagtggactagtggacagctttctttatagaattctccatcagtccagtatgctataggtacagtcctagctaaagacaggaaaatgtatttacagccgctgcccattgctgccattaccatctgagctccacctcctgtcagatcagtggcggcattcagttctcataggagtgcaaaccgtattgtgagctaggtgtgtgagggatcttggctggctgctccttaagagaatttaactaatgtctgatgatctgtcactgtctcccattacccccacatgggactgtctagttgcagaaaaacaagttcagagctcccactgattctacattatggtgagttgtacaattatttcattatatattacaatgtaataacaatagaaataaagtatacaataaatataatgcacttgaatcatcccaaaacaatactcctgccctgatccatggaaaaattgtcctgtgaaactggtccctagtgccaaaaaggttgggaccactgcaataaatcaacgtatctagaagccagataaagccagaacacaatttcaaaccagccctgaatccccatacttctctccctccccaggacatacacaaactgaagaatgtcacataaaatacatgatataaaaatgtatcaaattaccacacagtaataaactcaaaatttatagtcaccttaataaccagctctcttctgtcatccagtctgagttcaataggtttcttcccaatgaataaatcagtaactctggagagaactctggcgtctattagaggacgctttgtatcagccccttcttcactggtaagatggaatgctaaaagctttaatgctagcgaacggaccctgagaacacaaagtacttaagtcgaactttcgtgatatgcaaatgtctattttaaaagggcttgtaattacaagtaattatatatcaacaaagtacaataagtagtcacaattatactgccattactagtaataatttactttttctactaaaaattcttcgatatataattataatgatttattcaatgtaatagttataaaataaacatcagaaacaaaaaataataactacaaatgagacagactcactgagattaaatatcagtaaacttcaataagtacatctgcgaattaaatcaataactcctgtcttcaaatctagtgaactattctccaccataaaaagtatcacagaccgctgaccacagtccaaatgttaagttgaacccacaggagagtaatgacgctcataatggaagtgtgataacactacaatgtatcaaaatcttctcatattaggggccaaacagattcctgtcaaatatgaaaatacaaatactttttccttatctggaagggattaggaataaggtcagctgagtggggaggtgggagacctttcaagaaaagagtaaatactgtatgccactaaacaatgaaatagagaaacagaaaaaccactgagtggacaaaggtcactgaggcggcagatattgagacaaccatgtatctgtcactcctctgataggttcttgaactacctggaaactggacaaattttaagcaataatacaagttgccaggttttaagaactacctataagacaacaattaaaacatgcatcattagggtggccctcctactacagactagagcaggttgccttctgtatgcaggcctgccaccttgagcccctgtatcataacttttatctcactttatgacaattaataataaagaataattgataataagagctatattcccggttacacactaaatgctgaaagggcagggcccatgtctgtgttgtgtgctgctacgttcccacagctcatagatacatagtaagacacccaataaatacttcctgaatcaaacacaaagtagatatttactgcaatattgttaactgatatcatctccagaggactaataagtcaggcaaactttctccctctccatttcctgagttacctcaagagagcttagaaaggctaaacacctacctaatagttttcctttgttccttacattctaagccaatgatatctgtattcacatctggggttgtcagttgagagacaggtataacccctagcaaaggtggctagagatgagatatgtaaagcatgtatttatgcatcttgttctctggtatatacatttagcatctttttaggtttagcataggatgccagaatccagttattcctatacatgtatgtcattctttaaaacttttgagtacagtcatgtactgcataacaatgttacagtcaacagtagatcacatatgcaacagtggtgtcataggattatattactatatttttctaaaccttttctatgtttagatacacaaatgccactgtgttacaactgcatatggtattcagtacagtaacatgctgtacaggtttgtagcctagaagcaataggctataggatatagcctaggttatgtatgtagttaagttattattgcttaggtttgtgtaaggtacattctatgatgttcacacaaggacaaaatcacctaacaaagcatttctcaggatgcatccatgtcattaagcaacgcatgactgtgtatttatgtataaggtacgctatgaagttctgagaatataaagattagccaacggacagggttcctgtctacatggagtttatggatgggttgatgggatggggtagaattaatacaataaggaaaacaaatatgtcatttgaattgtttcaaattctatataatagagacttatcttacccaaagaaagatctggcctttccttgcactatgctcctgggggtgtcctgccttagaatgtctttattaaactgaggaccttgggcccgaaaaacaaacaagaaatgccccctattgtgttaattctccaaactgggggtttgttcaagtaaggagtaccacactagcatgttaattaacagggaacagcttttctgcatgtgtagaagacaacccctgagaacacaagcacgttaactccctctgccctacttcttcctggatcacccataacattactctctacaatacagagatattttaaagactataattttcctccttccattctcttaatagtttagttaacttccacctatttccttatctttcagtccaatgatctgtctataaataagctgctgtattttcctgatgtaaggtttgggaaacacaaattatccattgtgaaaagaatgtctgtccattcttcctagccttttcaaccaactattcctctttatccctgcttatccatctcgactcagcatttttttcttttttcagtaagggaaaatctaaccactgttacctaaaaataataatagaaaagattcatgttgcaatgacagagaaggaagaaaaacagtatcattctccttcttttcattaattaaaacaatgcttatattaatggcagtcaaagaaaggatatgttttcagttccccaagtaagaacacagctatatgggattaaaatacctgcataactctggtatttgagacaactggcctactatacttatgaaaaactgaatattcagaacagatgtttacaaaaggatcactctggaaggctaacaatttctaaagagaagatgggaatgcactataatttttaccatctatttatctccatggctctccaacttgcctagggcactactgagcggcacttagtagcagtcctgtaacacaggctgatctggcaaggaataacttggctgtaaagtggatgaaacgtcagcaagtacatacaagaccttgtatctgcttagtttcacgcattggtttcctctagtaatggaataacaccctccttaaaaattctttagttttgtttcaaattatatatagttactatactttcttagcatgtttccatcaatctttgacgttcacaagattacgttgtactcacgatggctttttcactagcaaaagtcgcagcatggactttaatcgggtagtacacggaagcatctcttctgtgtcagaacttgctttgcttagaaggagaatgcagttacccagaggatcttctgtgtcggcatagccctaatagatttgtttttaaagagaaattattgtctaattgtatacataacttttcaacttgaaaataagaattgtattgtcctatcagcaactcataaatgtctttggattcagttgaataaaatcattattttttaaaataacttctatgagccaaggagcctaaataaaactgtatttaaaagaaaatacacatacatacaggagaacttcaggaaaacatgccaaccttcttgacacttgctgatttttctattttctaagattctaatagtggcacctcccctcggtgaagcacctcacagatcctcagcccatccccaccctaagaagatggagtgctctaaatgctacacgcatggaatctgtgagtctcaaggcacaaggcccaggctctctcttctaaaagaggactgtgcttatgatggcatttctgaactccaccttttcatccaaaagagacaggaaactgactcctttaatgtccagaaggattgcttttttaaaaaaaaaaaaaaaagctgtttctaggagcatgttaattacggtatcactctaatcatacatatgcatggatagaactcatgaggcaagttagttatgtaaggtctccttaaaaagcactgttagctctgcctaaaagcctttatataaggttgagttctatttttcacagtcaatgctgtgaatgcacctcactttttaacctcccacccagatatataaaatatatacagacaaattagctatcctggtttaactttctgccagaaacaagacagccacccacttcctgttcacttatccccagcgccttcacagcttctcttcatttctctcacaacttgacagtttagctgtttgcatgcatttaaatcaatcacacccagccaaagataaatggtatcataaaaagtgaatttcacagaatacctgtagtattgggatgacaggacagagagattcaataaacttgttccaggtcaatgctgtcatcatcaatcgtccctgaagcaggtataacagaatggccttggcagcagtgttcacctgctcaacaacacagacccgataaaccagtcaaatgagatgtcccgctaggtcacctgacacacctggaacattttatagcatgtggaaagatgctataattaacatctctttctttcaaatgttcgtacttccacagcatcatcttacattctgttctgtttttcttccttaatatttctaattttttacctttaatgtacatttgtcccttgagtaaaaatttccctaactgaaataatctgcttactacctgtactgtatagttctctacatcttagatgaaaaatgtaagtaaactgatctgaattttttgaaatcaagtgtgtcctgtatttttattcccacattttatgtaacatttatttttatttaaataacacttcaactgaaccaatgcaccaaagacaggtttctttttagtttctcaccatgctatctaaactatattagaatatcaccttgatttagctgagtatctaagttactgtaatattttcactcatgtttaatgtcatacctcactttcgggctcttgaatgccaaatacagagatttcatacagaacttttggatgaagtagaaaatgaattccattgcaaagtgaagacacgggtttagtgacattatggacacctaaacattcctgtaaaataatattaaaaagtatttttaaattagcaacactgatttttccaaaagatccatctttcttctgtttacaatcccatttctattttagtttttacttcattgaaactttttttaacaagacagaatgaaaaagattctcctgtctaacagtttcttagtttgtaggagatacatattatattactttctgccacaagcataatcatgataaattaagtaaacaaacggctgagacaaccataatctcttaaagttaattcatcatgacagacacaaaggacataaacacagtaagaaacttatcctaaggtgtttgcattttacttacaaaggttgggaaagaaaaattcaacatgaaaagacttcaaggacttcaagttatgggagacataactttatatactatatatatttatattctatatatatagaatataaagaatacatattttatatataatatacctattatatataattttttatgctacatatttatgtcctatatatgtgatatatatatgattatataaagttatcatcaatacagctatgtacctaaaatacaattactttgaaccaacacttagagtaactatcaggaatttttttctcaatatgtgatagagaatagtattttgttagcagctatttaaggtgagaggggaaaaaaagctacttgaaatattaatggaatttaaatacaatatagaaggtaaaaatacaataaataatgagttacatgaatactactttttttcattctgcaaatttctacttcctattatcaacaattcaaaggtcaaaaagttacacacatacactcacatatgtatttgcatacattatttttctttcaactgttaacttcatgccacagacagcaacttcgttcatattacaaggttttcaaagatctaaagcctcagccctaaacaatagctgtcacctacttccttaagatacttatctaccatctaaactgtgactatccccttctgaaaccaagatttacttcctaaaattgtcttatttttctccagcacctttatttttcttcacatgattattctaatcaccatatgacatattctaatgtgtctatggccctggctttctcctcttgataacaattcatttttcagctctccttcccaccacgagtcctcacaagagttcgctgtcctcagtcagtacttcctcatttgccaaaccctcttcaatgcacatcagcaggacttaggttcctaccattccacaggagcttctcatagaggacaccaacaacctcaacgatgccaaatccaacgtgttcatctctgttctcatgtgactcttccttctaacctctgtctccacttctggctccctctgttcccaacttctaactggttagatcctagacagccttctcttccctagtctctcagtagttgatcctatcaaggcttgtggctttaatatcatctctaagctgatgactgaaaattttatacctaatctgggctccacactccaaaggtagtgtggtgcaatgcttaagaatatgggctttggagtgagcctatagggttcaaagcccagtttcaccacttttagttgaatgaccttggacaaattcaaagtatctccgttttcagaaagaggtagtacctagctcacagagctgttaggaggattcaatgagataatatacttataaaagtacttgatacataagagtaaatgctcaataaatgttagctgctatcattatcaatgaaattattagcattagcattattatatttaacagtctacttaacatatgcacttgatataaaaaggcatgtcaaacttaggttcaaaacagaattctacccaatccacaatcccatatttgggacatcaatccaactgctagatccaaaaccttaaaattcatccttgatcactctctatctcctactctcattatcagcaagaccaattagctccacgtccgtaatacctcctaaattcatttccttctcttcatctccactacaccaccacatctcatcagggctactacaatgaaactggtcttcttgcttccatcctgaccccctacaatccattccccacaatgggagagtgatcttttcagaaagatcatcagatcacgttaaaatcattcatagcatctcactgtacttagaatacaattcatagctttataatgtttggcaccctgcctacttttcagacccaatctggtaccatttttctattatctcattatactgcccttctttttgttcgtgaaacacgcaaagtacattctcacctgaaaagcagaggcttttcacctgttgtttcctcgggctagaaattctccctccctccctagccagcctacataaatttagtccacgttactagtcattctctagtcctttatcctttcattgtctttacaacactattttatttaaaacactatatacattgaatgtatatgcagtgttgtaaactatatatatatatacatattctatacatatagtgttataaagaaaactatatatacatatatacacacacacatacacatacatactttttatgtatttaaggaatttttcttaattattacatacatctctctctgtcccctatcagaatataagctctctgataaggctcttttctgtactttatatcactacagtctagcatatggtaaagtgtccagtaaatattgctaaatgaatgttagatgtaggtaacatggaagtggtggccatttaatcatccctaaatttaaaagctattttacctctttaccataccgtcctcaaagttaagtcttacaataaaaagctaacttgcctcttcagaaaaagtaacctccacattactagcacgctcctacatttaggtaggtaaagctgcagcaatgccttggagatttaccagaagacactggaataatatcatctgacagacatagccaattaaagtgaaatgcctttacaaatccttatatccaaaccaagatactatatctttatgacacaggggctaactacaagaaatctcatcatttggagcttttgacttggattattataactccctgatagtaaatacacatgaattttttaaaaccacattgcactatacagatgattatcttttgtgacaaaagaaaaatcacaatattttgcaagaacagtgtcaactaatataaatttccaaatagttaacaagaaaataaaacattaaatgaaagttcacattcttttattttatctccttctacaactaggataataaggcgagttttaacaaaaaatattctttcagtttaaattttgcaacaaaatgtatgacacttggttataaaaactatagtatattaaaatttagaattttcaaaattactaaaattcagtgcattttttttaaaaacaaattcgaaactgacacatacatatttatttctgacattccttttttcctatcattctatgacaggaaaaattatctggatgttaattttttagaactcctctaaaaaattaacatccagattattcctacttgaaattcatcatataccaaaatgatcatatacatcaataactcaatttacaccaaatattttcctatctgcaaaaatttttatttccaataattatttaaaatctgcctcaagaaagatatcaaatcgtattccaccattttaaatttcggggtataataactatcccaaatacagtgatcttagtttcttgacctatttatctcaatgatactcacctgccctataactgaggaccccttctcttttcacttgttctacctctaaaatcataaatgtaggtttctaatcttcttactcaacttgaaatatggtccttctttgacctccagtccataaacccttctactttcttccctgtagtctttacagcctttggttctacagtcgacatgtcatttcaactactcagctcacttgcaccacaggcattccctcctccccgacagcaatgaaataactcaacccttgattgatcgcaaggttcacattcccagaaaccacaccagctagccaaagataaacatgcaaagtagaagagtctccctattaagattatagacacaattgactaagctcttcatgcagcccaaaaatgctactatttgatattatcaaatatctactcatattagtcatttcacacattcaacatctcactttcaatctcaaagaaaatacagactcaatagaaggaggctcctgcaacttcctgtgatatctaagcccacctaaccccaattagccatcatgttcaaggtcccaccgccttcaactttcaaaggcactagcttcttttaattagctacttgctacccactatcttcaatctttcctcctctgattctttttattatttcaacatacacaaatgaaaatgtaacttcattacaaaccccttccaaggtgcatcaccactaactgtcaaatccctaaaggcaaggcagaaacaaatatacaaccaccatctagagaatacaagatcacaagaaaaagctaccctgccaaagaagacctgaaaatcaaaataacagtatctgctaaaataaacaacataaggaagattcaatagccataacaagtgggaggattctaataccataatctaaacaagattataaaataaatatgtttaaaattcacaacaacacaaaagaagaaactagaggacttgttcctggccttgagcagctcttagggaagtggcaagtgcaacaggcatggagcagcccactcttgcaacgatcctctaggatcctaactatgggagaccccatgacctgcacagacctttgagttgcaagggagaactgcccaatgagttgccagagacagaatgccagtctgcacagagcccagagggtctggcgcagtaatggctgcaatggggcatggccataggtgcctgttgcgggaagtcagggaccccgaacggagggaccggctgaagccatgggagaagaatgtggattgtgaagatttcatggacatttattagttctccaaattaatacttttataatttcttatgcctgtctttactgcaatctctaaacataaattgtgaagatttcatggacacttatcacttccccaataaatacgcttgtgatttcctatgcctgtctttactttaatctcttaatcctgtcatctcgtaagctgaggaggatgtatgtcgcctcaggaccctgtgatgattgcgttaactgcacaaattgtagagcatgtgtgtttgaacaatatgaaatctgggatccttgaaaaaagaacagaataacagcaacgttcagggaacaagagagatcaccttaaactctgactgccggtgagccgggtggaacagagccatatttctcttctttcaaaagctaatgggagaaatatcactgaattctttttctcagcaaggaacatccctgagaaagagaatgtgcccttgaaggtgggtctctaaaatggcccccttgggtgtggccgtcttctatggtcgagactgtaggggtgaaataagccccagtctcccatagcgctcccaggcttactaggaagaggaaattcccatctaataaattttggtcagaccggttgctctcaaaccctgtctactgataagatgttatcaatgacaatggtgcccaaaacttcattagcaattttaattttgcctgcggtcctgcggtcctatgatctcgccctgcctccatttgccttgtgatattctattaccttgtgaagcacgtgatttttgtgacccacaccctatttgtacactccctccccttttgaaagtccctaataaaaacttgctggttttgcagcttgtgggacatcacggaacccaccgacatgtgatgtctcccccggacgcccagctttaaaatttccctcttttgtactctgtccctttatttcccaacccagccgacacttagggaaaacagaaaagaaactacgtgactattggggcaggttccctgataggtgcccatcacccaaatcttgatatactcctctaggtggctttagccttagttcgctgccagaagtagaaagagcagggctatctttcccacaagactgggccaacctgatctgaatgccaccctgtctgccagcctctcaaagggtcctgtctgtctcactagcttgcaacacagcctcagctgccctgccgaaatgctccccaacagccaccccataggtcttttgccaacagcctctgccttcctgtcagagcgcttttgcaagcacacacccacccacagccaatacctactggtgtgcacttgcctgcagcctcccctgccagtgcgcacttgcccatggttacccccaccacaagtgcactctcccaaagcaccgccccacgcccccccagagcactttctcgggcagtcaccatcggaaagttgttgccagcagtctgggaacatctcggctcctccagtgcagcagatgcttgacctcaagggaccagaaatcaaagccactggcctgttcagtgcacccccagggttagagcacacagcccaggggtgctgagctgagctctggccctgaaagcacacagaaaccaagccaattgactaatcccaacttataccacagtaaaatcctcaatggcatcaaataatataaaagcaaaaggccccatccaaagtacagcaacttcaaagattaaaggaacatctgcccacacaggtaagaaaaaaacagtgtaagaattctggcaattctaaaagccagaatgtcttcttattttcaaataaccacactagctccccagcaatcgttcttaaccaaactgaaatggctaaaatgacagaattcagaagctggaaggcaaggaagctcgacaagatatagaagaaggctgaagccccacccatggaaaccagtaaaatggtggtttgatccatgattggatctgacacaaacattttaagtaagaacaaaactgaacttctggaaacaaaaatttcatgataggaatttcataatgcaattggaagcattaataacataactgaggaaaaaaatctcagagctcaaagactactcctttgaatcatcacaggcaaacagaaataaagaaaaaagaattaaaaaaaaaaacttcaagaaatatgggattatgtaaacaaaacgaacctaacacccatcagcattccagaaagagaaggagagagagcaagcaacttggaaggcatatttgtggatattttccacgaaaatttctccaacctcactaggcaggtcaataagcaaattcaggaaactcagagaaccccagtgagatactattcaagatgaccacccccaagacacatagtcatcagattctccaaggtcaacaggaaagaaaaaatcttaaaaggaagctagaaagaaagagcaggtcacatataaaaagaactccatcaggctaacagcagacctttcagcagaaaccttacaagccagaaaagattggggacctataatcagcatgcttaaagaaattcaaaccaagtatttcatatccagccaagctaagcttcataagcaaaggaaaaacaaaattattttcagagaagcaaacgctcagggaattcattaccatgagacctgacttacaaggggtcctcaatggagtgctaaaaaaggaagcaaaagaccattacctgcctccacaaaaacacactaaaatacatctcccactgacactatgatgcaactatacaatcaagtctacgtaacaaccagctagcaacatggcgacagaatcaaatcctcacatatcaatactgaccttgaacataaacgggctaaacaccccacttaaaaagcacagagtggcaagctggataaagaaccaagacccaactatatgctgtcaagagacccaactcacatgcagtgacacccacatgctcaaagtaatagaatggagataaagatctatccagcaaacagaaaacaaaaaaagagcaggagttgctcttcttatttcagacaaaacagactttaaaccaacaatgatcaaaaggataaagaaaggcattacataatgataaagggttcaattcaacaagaagatttaactatcctaaatataatgcacccagcattggagcacccagtcataaaacaagttcttagagacctacagagttttagacaaccacaaaataatagtgggagacttcaacaccccactgacagtgttagacaaatcactgaggcagaaaactaacaaaaatagttgggacctaaactcgacacctgaccaaatggacctaggagactctacagagtactccactcaacaaaagcaaaacacattcttctcatctgcacacagcacacactctaagatcaaccacacactcagctgtaaagcaattctcaacaaattcaagaaaaccgaaatcataccaaccacactctcaggccacagtgcaataaaaatagaaattattaccaagaagatctctcaaaaatgatacaattacagggaacttaaacaacctgcacctgaatgacttttgagtaaagaatgaaattaaggcagaaatcataaaattctttgaaactaacaaaaacagaaacacaatatatcagaatctttagaacacagctaaggcagtgttaagaggaaactatacagcactaaatgcctatatgaagaagttagaaagattgcaaactaacaacctgacaccacacttagaggaactagaaaagcaggagcaaaccaacctgaaagctagcagaagaaccaaaatcagggctgaactgaatgaaactgagacacaaaaattcacacaaaagatcgacaaaaccaaattttggttctccaaaagaatatacaagattgatatatcattagctagattaataaagaaaaaaagagacaatccaaataaacacaatcagaaatgacaaaagtgacattatcactgaccccacagaaagaccctcagagaccattaagaaaaactctatgcataccaaatagaaagcctagaagaaatggataaatttctggaaatatacaaactcccaagattggaccagaaagaaattaaaaccatgaacagaacagtaatgtgttcctccaaagttgaatcagtcattaaaaaataaaaaaagcctaccaaccagaaaaaaacactgggccagacaaactcacagccaaattctaccaaatgtaaaaagaactgttaccaatcctactgaaattattccaaaaaatgaaggaggagtgactcctccctaactcattctatgaggccagcatcatcctgataccaaaccctagcagagacacaacaaaaaaagaaaacttcaggccaatatctctgatggacataaatgtaaaaattctcaacaaaatattggtatactgaaaccagcaggacagcaaaaagctaatccaccacgatcaagtatgccttatccactggatgcaaggttgattcaacatatgcaaatcaataaatgtgattcatcacataaacagaaccaaaaagaaaaaccacatgatcatctcaacagacacagaaaaggcttttgataaaattcaacattccttcttgttaaaaaccctcatcaaactaggcattgaagcctcaaaataatgagttatccatgacaaagccacagccagtatcatactgaacaagcaaaagctagaaacagtccccttgagaaccagaacaagacaaagatgccaactctcaccacttctattcaatatgctattggaaggcctagccagatcaatcaggcaagaaaaataaaaggcatccaaataggaagaggaagttaaactctctctcttcacagatgattctatacctgaaaaaaaaaaaaaaaaaagaaaaaaccatattctctgcccaaaagttcttagaactgataaatgacttcggtgaagttccaagatataaaatcaatgtacaaaaatcagtagcatttctgtactccaataacatccaagctcagagccaaatcacaatgagaattgtaaaacactgcagaaagatatcagagatgacacaaatggaaaaacattctctgcttatgaataggaagaatcaatattgttaaaatggccatacttcccaaagcaatttacagattcaacactattcttatcaaactaccaatgtcattcttcacagaattagaaaaaaccattctaaaatttatatggaaccaaaaaaagagaccgaatagccaaagcaaacttaagcaaaaagaacaaagctggaggcatcagactgcctgacttcaaactatactatggggctacagtaaccaaaacagcatggtactggtacaaaaacagatacacaggccactagaacaggttagagaacacaaaaatatagccagacacctacaaccatctgatctttgaaaagacaacaataacaaacaacggggaaataactccctactcagtaaacagtgctggaataactggttaggcgtattcaaaagattgaaactggacccccttcctttcaccatatataaaaatcaactcaaaatggattagacttaaatgtaagacttaaaactataacaaccctaggaaataccattctggacacaggtcttggaaaatatttcatgatgaagtctccaaaaaaagcaattgcaacaaaaacagaaatagataagtgggacctaatgaaactaaaaagtttctgcacagtaaaagaaactatcaactaagtaaaaatatcaactaagtaaaaagcctacagaatgggagaaaatatttgcaaactatgcatgtgacaaaggtctaatatccagaatctataaggaacttaaatcaacaagtaaaaaacaaataaccccattacaaatgggcaaaggacataaacagacacttctcaaaagaagacatacacacggtcaacaaacacatgaaaaaatgctcaatatcactaatcattagaaaaattcaaatcaaaaccacaatgagatatcatctcataccagtcagaatggctattattaaaaagtaaaagaataacaggtgttggcaaggttggagagaaaagggaacacagtactataagccctatacactgcttgtgggaatttaaattagttcagtcactgtggaaaacagtttggagatgtctcaaagaaattaaaacagaactaccatttgacctagcaatcccttactgggtatagacccaaaaaaatataaatctttctaccagaaagacacatgaacccagatgttcactgcagcattactcacaatagcaaagacatgggatcaacctagatgcccatcaacagtggattggataaagaaactatggtacatatacatcatggaaaactactcagccattaaaaaagaataaaataatgtcttttgcagcaacatggatgcaaccagaggccattatcctaagtgaattaacacagaaaaaccaaatacagcacattctcacttagaagtgggaactaaacactgcgtatacacatggatacaaagatgggaacaacagacagtggggcctacttcacaagggaaggtgggaagagaacgtattagcctattctcacactgctataaggacatacccgagactgggtaatacataaggaaagaagtttaattgactcacagttctgcatggctgaggaagtctcaggaaataatcatgtcagaaggcacctcttcacagggcggcaggagagagacagaatgccagcagagacaatgccagatgtttataaaaccatcagatctcatgagaactcactcactgttagaagaacaggatgggggaaactgcccccatgattccaattacctcctcccactgggtccctcccacgacacgtggggattacagaattacaattcaagatgagatttgggtggggacacaaagacaaaccatatcagagggtgaggatcaaaaaactacctattgggtactatgctcactacctggctgacaaaatcatttgtacaccaaaccccagcagcacacaatttacccatgtaacaaacctgcacatgtacccccaaccctaaaataaaagttgaaaaaaaaaaaaaaaaaacagaaactaatgaaagattacatgaaaaaagaacaagtcagttaaagaaagcaaagaaaaggtatagacatgaaaaacagtataagtgataatcaaaacttgataaatttaaaaaaaactatgatgggaaatgactttgcacccattaggatggttactattattaaaaaaaaaaaaaaaaaaaaaaaaaaaaacaaggccagacacggtggctcacatttgtaatcccagcactttgggaggccgaggtgggtggatcatgaggtcaagagatcgagaccatcctggccaacatggtgaaaccccatctctactaaaaatacaaaacttagctgggcatggtgatgcacgcctgtagtcccagctacttgggaggctgaggcaggagaatcacttgaacccgggaggcagaggttgctgtgagccaagattgtgccactgcactccagcctggtgacacagcgagactccatctcaaaaaaaaaaaaaatccagataaaaagtattgccaaggatgaagagaaactggaatccttggcactgccagtgggaacataaaatagtacagtcactgtggaaaacagtagggcaattcctcaaaaattaaacacagaattactgtgtgatctaccaattccacttctgggtatataaacaattgcaaaaagatggaaacaacccaaatgcctatcaacggatgaataaacaaaatgtagtataggatgagtgtcccttatctgaaatgcttgggaccagaagtgtttcagattttgaaattatttggatttcttaatatttgcattatactttccagttgagcatccctaatctgaaaattcaaaactggaaatgctccaacgtgcatttcctttaagtgtcatttcggcactcgaaaagtgtcagattgtggagccttttagattttggattttcagaattggagtgttcatatatacagacaatagattattattaagtcttaaaaaggaatgaaatgttgatacatgttacaacatggatgagccttgagaacattatattaagtgaaataagccagtaacaaaaagacaaacactgtatgattctacttatatgagttacctagggacctcaaattcatagagacagaaagtagaaaggtggctgtcaggggctgggagaaggggagaatgaggagttattgtttaatgactataaagtttcaatttgggagatgggtaatggtgatgatggtacaacaatacgaatgtacttatgccactgaattgtacactcagaacatagttaaaatggtaaaattttttccttttttttttttttttccagaaatgaagtactcactctgttgcctaggcttgagtgcagtggcatgatcacagctctctgtaccttgacctcccagtctcaagcaatcctcctgcctcagcctcccaagtagctgggactacaggcacatgccaccatgcccagctattttttttttttttcttgtacaaacaggatttccctatgttgcccaggctggtctcaaactcctgggctccagtgatcctcctgctttggccttcccaaatgctgggattacaggcatgagccaccacacctggcctaaaataaattttatgttatatatacatatcaccatcaaaaaaagtaaattagacaaagctgaggaaagaattagtgtactgaaaggataacactgagaaattctacccaaataaaacctaaaaagatgtggaaaatatgaaagaaggcttaaaagacacaaagggtaaactaagaaggtctaacacaggtctaataagagttccacttggagaaaacagcaaggataagagaaaagcaatattcaaaataagcatgaccaagaattatacagaagtgaaggcagatggagtgttcaaagcgaaaagtcctaagcaagataaatggaaaatcatgtatgcatggagacatattttaatgaaaccgcagggcaccacagaaaaggaaaatattttaaaacaaactagagaaaaaaattaaaagaaatcataattaactgatatcagacttctcaacaatgatagaagccgaataagaattaagcaatactggcaaagtgctaataaaaactagcagtcaacctgtattttatatgcagccaaattactattcaaaataaagtgaaatcatgacattttcaaacgtatgcacacagtcacagactgtcactgaaaatactgaaaaacttacttcaataaaaaggagactgaacctaaatatttatcattcaataaaaggaagtatattcaaacttaatagcagttaaggtgaatgaactaggcaaatctcaaatcctgctatatatactaatcatgctatatataaaattctttaaattatttaaagataatatttatatataaagatacagctttataaataatatacaacaactggatgggaagaatatacaccagctgtgtaagagtggctaggctatgctggtgggagaagagaaagcaaagaagcttcctctataactagtatttttctttgaataaaaatgaatcagaagtaaaaatggcaaaatgtaaacacttattataaccaaatagtacttacaagagtgttaaatacaaaaggacactttcaagagtacgcagtaatatatatacttttaaatattgtcctatgtacagtgttcttttcaatattgaaatatttaatattctatgctgaaatattttatcatttaagaagacagaaaaataaatatttcaaaagaaaagaaaaataaaaaataacattaaaaaaaacagaattaaaaccataaaatctaggccacaacaacctaaaaggtttcctgggcatagaaatcacttttgaatacctggaaatcaattttccttataatttttccatcattaatacaacataaatgtaattcttaataaaacttcaaataaagcaattcaattgctggacttactaagttaagagaatttaatagtacaaattttccagaattgactagtaattatcatctacttttatgggatatagttcttatatctcatacaaaaggtcaagtaaattaagtttgaaggtataacaagagagtctactatttgttctcaaaaacaaaacatacgaaaaaacaaaacctcaccttcgtgatttccagacagcagtggtaagtttcagctttcactcgtggcaatgggtgagacaacatatggagaagcaccttctgactttctccttgtagtaatggactggcctgagcagatttccagctggtgaaaaggtaaaacaaccaagacatgtgaggcaagtaagttagtaagcaaaagactgcaaagcatactggaagggatttcttcctactccaactcctcaaactgagatcttattaaaaataaccaatactagcaagtactcacctaagcacttatttgtttcagggcagaggaggttctgtcttaaagagtatttttaaaaacccaaaatgtctttaaaatcccctactcagttaatgattatcacatcacagaatttattctttccaaaagcaataaagacactaagttctaaatagaaatttgctgatgtcctcaaaataaattaaccaatacacagtcttttctaaaaatccacataagaaaaaggtacaaagtaataaaagttacaaaactctcagtttaagttattaattaaaactttaaagataaataaacaatgtgtgtgaatagtctggatggataccaaaaacaaatgtataaaaatccaaggattattcattttgattgtaggcatgacatttttgaagtttaatcttgaatataacagttaagtatcctaatgcagctgtacatataccctttaaaaatcagacacatataaaagcaattaaactaaaaaataataacaaagatatacagtcagtttcactttcactgtttctaagtttacacacaccctaagtgtccaataataacgtaatcacattaagaaagaaaatattacatctttgaacaaatgctgatgatttcctttattagcgggaaatgctgatgataggaaaagctacgcaaggcttggtctgccagctccactaattctaagagattcttctctccctacaaaagaagcagaatggaacaataaatgtcaagttcatgtgcaatgatattctcaacagctaactaagcagcttcaagaaattagaccattcagagaccatgagactgtttacatttgtttaagtccactttctcatcaagcaacctaaaaatgtcagccgaggtggagaaatgtaggaaaattccctagctaaatgccacatgagactttctattatttaactctgagtaagcttaaagttacaatcaagttgcctggttctttgattacttctttgtagctctacctcccctaataaaagtagggctaatgtatttattttattataaacctgcctcttgtagcagcctgaccactaggaacacacaggacattgaacacatgtgtgattaactgaccacacaaaatgccacagaggccagacccagtggctcccagcacttcgggaggccgaggcgggcagatcacttgaggtcaggagttcaagactaacctggccaacatggcgaaaccccgtctctactaaaaatacaaaaaattagctggttgtggtggcacgagcctgtaatcccagctacttgagaggctgaggcgggaggtggagcttgcagtgcgccaagactgcaccactgcactccagcctgggagacagagtgagatttcgtctcaaaaaaaaaaaaaagccacagaaatacttcaacttaaagacacaattcaaaattctatcacagagaaaacaagaagacagtggtactaacatggcaaaaggaaaggggaaaaaaaacaaactacagtggtaagtaagaaaaatcataaatatcaagttcaaggccaggcacggtggctaacacctttaatcctagcattttgggaggccaaggtgggaggacagcttgacgccaggagttcaagaccagcctgggcaacacagtgagacctcatctctacaaaacaatttaaatattagccaggtgtggtagcatgtgcctatagtactagttgcttaggaggccaaggcagatggattgctggagcccaagagatcaaggctgtagcctaggcaactgagaaggctgtcaaaaaaaaaaaaaattcaaagaaaataaataggttcagatagattctactgtaggcaccaaaatgagtaagaattttatccctaattcttcaagatcttcaggatccatgtccttattttcaaacaataaacaactcttgtatcaatgtctgtctctaagacccattaaccctttcattgataacatactaatattctaatagtatttttaaaagggataaataccgacacataattattgctgtaacactgccataaagtcatcctaatacattataaacaatgtagttcatcactgtacttaatatatttcaaaaatcagcctttatatatatgtaagaactatctataaaatattgaggcaaaaatatgtctacaagtaagcactaaaatagcccttataattttggttacatcaactgtcattcagttcatatcagtaagtcacttaatagaggtactcattattaaatattaagacatttgtaataaccactgcttttttgtaaatcactgatgttaggaatatacaccattaattaaagtcttcgttttacttctatacaaatcatatccttactttaacctgttaaataacaggttatgtataattgacccactcaggaataatgtatcccacctgtgacaatttaattatatgtccatcaatttgaaaagtatagattaaattttcaaaatatgtcaaagggatttaaaagagatattaaaaaagctttttacctctttcccaatatcagacaggaagttacaggtgcattcaattgaataaacggcctctgcagttcgtttataaatactgtagttttcagaattcagctgttccaaataggccacaacagcttcatgaatatttggatattccaaagaaataggcatgtccaaagaaaggagaaataatgctgttgacataggctctgataaaaactcgcttgccttggtgaattaaaaaaacaaaaaaattaaaactttgtttaaaaaaaacttattttagagaaacatagtgggctatagtcttaatctaatccaacttcctttttagcaattctttgtcaaaaaactgaaactttttccaaagaaaatcccatttcccaacacatcatctacctctatctctgtcttttttcaatacaaaatgtctcaagtccaaatatcaactctttctcaaagcctaagatactaactactttcttcttccccaaaccaacttcttctctccttgagccctgcaccttgtatatacctctgctattgaactaaggcatgaggcctttttctctaagtattttctgtacatgtacgcaaatctccccaataacctgataaactgaagacaagaacacttccccatcccatagctgaacatgacagagcttattaatgacatattaataacacgaaatcaagtatagctatagattgatttgaacagaaacgaatttttttctttggttttgtcttttagaggggatagtggaaatccaatataatattttaaatagttctaaaatacagaagatagccccttaattagtataaaatcaatatgcccaaatgaaatattatacacattataaccttaaatcaatagatttaaaactgaaagaattatggtttttaaaaaaatggttctagttttgtgacaggattctaaatatcaattaaaggaataaaaaggactaaaaatttgacgttcagagaaaatctcttgacaagactcactattacggctgaaatgctgtctttacaaaagtgggtttggtcatgatttatttcatggataacctatttcaaggataatcattaactacctgaaagtctaagagctgaatcagctaaacaacgatacctttaaatgaatatagttgctaaatgaagatcagaaactacagaaatcaaaattttagattacacagacatgacaaacctccagattagtaaaacagcagctattagaaagtaaagagaaatttcattattctgtgaagaactttccttttttttgtgggcgggggaggaaaaagagaaactcaattatctgctcacctattattcactcactcggtgaatattaattaggccttactatgttcctccactatatgccaggtacctctccagtcctgggaacccagcagagagcaaaatacaacctctgcccgcatgaagctcacatcccactgaagaaagtagagtgtaaatcgatatacttcctaagatgttaggtgtggctaaaaagtgttttaaaacaggataggaaagatgaagaggaacagagaagtaatggggagtggaggcagggaactgctacttctccaaagtagtagaggaaggcctcgctaataagatgacatttaagtagaaccctggaagggtcaggagccacgtggctatctgagggaaagcatttatagaagagggaagagcaattacaaaaactattatttggtagcaagaaagccagtggagctggttctgagggatggagtcagaaaggagtggtgggccagatcagttaaggctttgggtcgtcataaggaattgtcctctgctgaaagccactggaacattttaaacaagtatcaaaattggtctgtagagaactgatggtaatgtgcaaaagtggaagctaagagacagaggactttactgcagtaatccaggcaggacagaatggtgggcttaactcaggtattcagattctgtataggtattcaagggagaaatgacaaattttgctcagggattatatccacatatgagcaaaagaaaggaatcaaggctgactctaaggtttttgcctgatcaacgatcaacttgaacaacaaagttgacatttaccgagacaggcaagactataggaagaacatatttggaaggggaaacaaagaatgaagtttgggacatgttcagttggagacatttattgtcacccaagtgaagacatcaaaaaggacactggatacaggtaagttcagagttcaggttatatgtctggtctggaagtataaatttggcaggcatcaacaaatagatggcatttaacaatcacaaatgggatatatttcatgagggctactgtcagtcctggggttccactcctgaagagttaggaagataaagagaaattagcaaaggcgatttacactgtgctaagagagtaaatcctaatggatctaactctaaaggcactgtgttctagtttaagagagttctctctgactctagtcagaaaaataacagctgctgtgagaattaaacaagcattaagcagagcatatggcatatagcactcaataaatattaatttccttttctcgcttcaccacaaaggaattccaatgtttcaccctgcgtacttgtatttgaaactcttgctatctcaacaactcaaagccccatgctaatgtcattagctaatctttacatggcccaatggactaatcacaatttacacccctaatctaagatagctgtcctgcatatataagcattagtcacatgccatcagaactaaaagtgaagatgtttcagtgcaaatccatcaccccattagataaaaaataatcagcaacatcacctcatgtgcattgggaggaggggctataaatgtttcctgtaaactagccactcagcagccatggcataattctatgagtctgttagaaatgccggctctcaggccctaccctttacctgatgaatcagaatatgcaagatgtgattaacaatatctctaagtgatctgtttgaacattaccgtttgaaaagcactgctctcagtcactcaactggcttcaccaggtcattagatctttttatatacctccctgaaaagctaaagaccttgtgttacaaattcttccttagccttggtaagcatcactagctaagagtaacagcagttcctagaatgctctgtgcttctgcttccagaacagggctagtacttttagctcttacttcccagatgtttccccaaatgaaattaccttcatttgttttaccaatttagtttactcaaccacaatatttttcagaagattaccaacgtatcattttaacctatacatgagtattctccaaaatcatttaatatcaacaaatatcagtttcaaaacaggcatcagaggacattttgttaaacttaggaaatctctacatagattcatatttattttccaacatccaaactacctacttggtcagtggcaactcaaaaaaaccactttaaaggcaaaaagtttcagagtccaaattctacttcaattattagtgggctagcaacagacagagggcagcataaccttacatttatataaaccaaagaagaaatttaacatcaatgaaatagcatttttgtttagatctcattttaaagtacttagtcaattaatcaaaacaaatataatcatctaaaaacaaataccttaattacaatctcccacaatgatcaaaattgttttaataaagttccaagttatatatttaaaataactaccaaaaattagataattgatttgtttttaaaaacggaaacaataaaacaataactacctttaaaaaaaaaagcatggaaaattaactttacattattctggcactaagtaaaataaattactgatttctttttggttcctgtccaaataagcacatagatgaaaaaatacaatcaaaaactacatgatgcaactgataggataagttttccatcaatacttcgacccatagatagattgaccatttgcaatacttaatagcaagcaattgtagcaccactaatttttcatttatataatattaaggaagacacccatattttaaattcaattcctttcttaagagactggaattcttccattcttgatgcttatgccttgaaaaattgtcactcttcaaaacagaaaaggacttcagaaacataatgactagtgaatacaagttaaaaattaaaagtaacacaagtgatgttattttccttaaagcaaaatactatatttaaaatgcagtgttttatccgttttcctggatcacctgataatacattgtgtatataagtgatacttagaaaatggagtttgggccaggcgcggtggctcatgcctataatcccagcacattgggaggccaaggcaggcaaaacaagaggtcaagagatcgagaccatcctggctaacatggtgaaacaccatctctactaaaaatacaaaaattagccgggcatggtggggcacacctgcaatcccagctactcgggaggctgaggcaggagaatggcttgaacccaggaggcggaggttgcagtgagcggagatcacgccactgaactccagcctggtgacagagcaagactccaactcaaaaaaaaaaaaaaaaaaaagaaaatagagtttggactatatgctctacagaattctaggaaacaaagctgcaaatgtttaataactaagggcaacaaagaggcataaggaatagttttctagttttcataatttctcccatacctgcattttagtgtgtcactcctttgttttggtaataagtacaccacgaaacactgatgtctgaatgatctgagatatttttaccactaacattcaaattcagagataacctcacgtttaaaaatacagtcagtaagaagattttaaagaaatatttacacatattaaaatcacttttaacagacttcatacaatggaatattttgtaataaaagttaacaaattaatgctataggcaacaatagttatgaacctcaagaaggagttgagagagtacatactttataatttcatttaaacaacattcaaaacaggccaattgatctatagtgacagaagtcagaaaggagtgtggcttggagaaggagggagaggtaacagagaaggggtctttggaatgctggtaacattctattttctgttatgggggtggtcactttttaaagacagatgcattcacttagtagaaaaagcactgaactatgtacttttctgaatgtatatgaaagtttaaaaaaaaaaaaaaaagcctttacagaattaatgtttttttctgatagcattttaaaaatcatttaaaaatttaagtgttctagttaaactaacagtgcacaatttcagaaactgtaattggcaaacacacagaagagacaccagccttaggcactttcaaaaagtgcttctttttagtaatttcccggccatatattctcacaattatcttttccgtgtactactctttttatccattctttagttaaaaacaatgaaactcgtgaaactataatatttttaaattatgcttataataaaaacatgtttaagcattcagcctttgaactagtaatgccactaggaatttaagaatccaaaatatgagtaaacatgcgtaagtagcaattcagcatagtgttatttatcaaaataccaaaaaaagaaaaaaagaaacctaaaagcttaatttctggaatacttgtggaaatcatagaacatcttgctggtaaaatattagtacccattaaaatttatgaagtgtttaattaaatggaaaatgtatgttagataataagaaatggttaaaaaaaaaaaaaagagaataaacaggccaggtgcagtggctcacgcgagtactcccagcactttgggaggccgaggcgggcacatcacctgaggtcaggagttcaagatcagcctggcaaacatggcgaaatctggtctctactaaaaaaaaaaaatacgaaaattagctgggtgtggtggctcacacctataatcccagctacttgggaggctgaggaaggagaatcacttgaacctgggaggtggaggctgcagtgagccaagaaagtgccactgcactccagcctgggtgacagagtgagactccgtctcaaaaacaaaaccaaaaccaaaaaaaaaaaaaaaaaaaaagaataaataacttttatagacgctgtcaattggacttaaagcagaaaagaaaaaagcctcaaaactaacttgaaattataaatgaatttttattcttctttgtacatcaaaatgttttttaaatgaacattttattttctgaataaaagttaaaaactgaaaacaccaaagcttaagaaaagaaaggtctaggtaaaatagaaaagtaggaaaaagaaaagtactagaataaagactagcacagaagatagtttattgctatcatgggcagaaaagcagctttgtgaaagacacctaaagcaacacgttaattaaaaaaacaactttcaaaagacatactaaggtatgaaatcatatattacgtaactcaaactacaaatatggtttagacataaaacaagttaccaaatattaactagatgaatcaaataaaaatcaggatatttaatcctaccaaagatgacttctgaaattcttttgatcaggtgctaaaataaaaatattaagcaattaagttgctgacagaaaggaaatagtgggataccttcaagagaaatgcatgggaccaaaaaaaaaaaaaatcccttaagttactaaaatatgcaacacaccagcaatatacataaagtacaacaaatacaagaaataggacagtcctcagaaaccaacttgaccaatacttagaaactaaagcactgctaacagtattttgaatagataaaacaagaaaaagaaaaggttccatgacattaagatatgctaactataaaataatttctggagcagcaatggaaactattgtttgtattctgtgtgtcaaggaacctgggaaatagtgaataagtaaagaactctgacaacacgtacctagctgaagagaaggaaaggctactcttgatattaatgataagaaccaagacacacactgcagagataagatcagtaggctttcaatgccctccaatcaattaaaagatacaagtgtaccaattatatatgtatatatgtatggaaaaatgtattcgtatattaagacataatctcttccctcaagtgatcccaaagttattaaagaaaccaaagaagtcaaacatatacatgtatatgtatatgtatacgtagatgtagatgtagatgtatatgtatatgtatatgtatatgtatatgtatatgtatatgtatatgtatatgtatagataacagccaagtcttgtcttttacaaaactaagttccatgaggccagggactaattctaacctattcagttttacatccagcaagtaatactgttagtccactgtaagcaatcaataaattattcactgaatgaacaaggaataaacaaacgtacagactgcaataaaacatatgcaataaaagcaacagcacgattaaaaaataatttcccatcaaatgatttgtcaaaattgttcaaaatgttagccatttctcaatttctacatttcccatataacctgttacacttattttgaaaatggcctaaagcacaataccttcacaccatgaaaagagcagaagaaatttacaacagagcatttatttataatagtctgtaaagtacaaatgagcagcattgcctgccttaccttttcaacagggagaagcgtttgtagcagtcgaactgcaaacagggaaatgctgataaaggccattctgtggtgcacaagcatcacctctggctgctccaaactgatactacttttatggtagcacatggtttctccaagggctcccaacaccaggagtagtttctccttctgaaaacatttacacaacatgaaacagaagaaaacaaccaattttaggggccagtatacaaaagccatggagaacagtttaaaatattatcattttcattaaataggaaaacaaatcaaaacagaatttattcctgtgagaattaccaatgcctgctgacataatttaaaaagcacaaaagaatgataaaccacctacattttaaaaatacaataatcttttaagtatttaatatgatgaatcttaacaatgaataaatacaaacaatagaatataaaaggtaaatgaaccataatttcctcctagtttctagtgcctaattgttccaatttggaacgttaacacgcaaacccctcgtcaagtatttcttatgcttactatacgcctaacacagtggcaggcataatgaaagaacaatgcattagtacaagagacatgatgatctctgtcctcaaattgataccaacatttctaaagaaatgcatcaaggaaagtcaaataattaaaaaacaattaaatatcaaattttataaactctctttagataataaggtttcaagtggaaaatgttatgccatcataaatttaaataatttactacttcaagagaaatcatatcttttaaactaaaaggtatacattaaatatgaagaagaatctatgcatagtagactgtcttgtaagtcacatcaatatagacaaagtatatcccagatatactgatatgcccccataaactagcgggtaaaaggacaccctcagtaagaaagaaaaaaaaaactgaagtacttaactttcaattttccattgaaaacatatgaaaagaagaatgagaaatacctgcaaactaagaacaaaaatctaatataccagaatttcttcaattcaaggatgactatacagggaacaactaaaaggtatgaggcccaaaaagcacaagtcgttggcaagaatatggaaaaaatggaagccttgtgcattgctggtgggaatgtaaaatggtgcagccactgtggaaaatataatgggcagttcctcaaaaaaacacagaattatcatatgatccagcaaattccacttctgggaatatacccaaaagaactgaaagcagggtctccaaaagagatgtatacacacccaggttaacagcagcactattcacaacagccaaaaggtggaaacaatgaaagtggccactgaccaataaatgcagaaacaaaatgtggtatgttgtatatacatgcaagaaaaggaggccggacgcgatggctcacgcctgtaatcccagcaggattgaacttgaacccaggaggcagaggttgcagtgagccaagatcacaccactgctctcaggccttggcgacagagcaagactctgtctcaaagaaaaaaagaaaagggtgttgagcattcaaaaggaattaaattctgatacatgctacaacatgggtgaacctttaaaacataaaataaaataagccaaatacaaaagtaaaataagccagatacaaaaagacaaatatagattccacttatatgaggtaccaggagctggggataggcagaatgaggggttattgtttaatgggtacagagattccatttgagatgatgaaaaagttgcatagataatgataatggttgtacaacaatgtcactgcagaagtaaaaggaagacaaaatgatctacataagcaaaacaaggcaaaaacttttgagagtagaccaagcataactatactataaaaagtttaaattttcctataaatgaaacaatttcatattgaagtaaaaaacaaaaattaaaaatttatatataaatccttaactgtcatgggattataagtaaaaaaagaaaataaaattctaaaaaaactttgtgaataaaaggttaaaagttcaatgagtagtagaattaaaacaaaaattctaagcaatatgaatagtgaataatttagggcaaaataaattagagtaattttctactgatgacatgtttaacaataaagactcaataaaaatgagtctgtgatctgaataaaacaggacatcaacaaaacatgttattgatatggacttataaattttaactcagtctttttgaacataattaaaattaatagacataaactttgaacactgcaaagaatataacttctccttaagtttccaagaaacactgacaaaaattaactttaaacatactttaccacaaagaaaacttcagtgtatatttaaggctatatttctctgatccccaagaaataaaactaaaaagcaataaatatttaaaccgaaagtagaacaatccttacaaaattaaaacagaaaaagtaaaacgccctcatacaaacaactactggtctagagaaaacaaattggaaatacagtgacagtcttattatattgacaggcaattaattcctccatacagtatttctccatgaaaacagtactaggaacaacatctctattattcaagtctatttacttgtgaaattgtttaaaataatcttgctaattctaatgatgaattgagtacttctcaaaatatcataaaaagaaaatactttaggaatgagttttacagttctatttccaacatttcttctaagcataaaaaaaatggctttttgtattgttttgttttgttttgtaggaaaggattgaaaaacaatagtaactggcccacattttttaattctttgggctaaagatgtttaagcaacaaccctaaaggagttgacggtgggggaaaagacccgtcctcacaggatactcatagtttttacaacagaaggtacaaaattgaaataccaggttagcaaaatgtcttaaatattaccaataaaacagattttatagtgtaaacacaacttacacactacctctgcaatatacaatgggttgtggattctacaaggcacctggagtaagaaactgcagcaggctctgcccctcacatgcttccaatggaccttccacactgcagccagtcacggttcctcctgccagtctcacaaggcacttctctgattaaaagcaatctcatcatgccttcagaggaaaggcaggactactcagcatcatgccaaaagacccctaccagcagaccctcatttatcccaccagtctctctccactatttgcacctcacatttcatggtctaggtgcttgtgttccatctactaccaggcctatcctttatctccgatcagaactatccatgcctctttgtcatggctcatggttcattctcacgctccgccagattaaaaaaaaaaaatgctattttatttgcttggccaaatcctacctataatttaaaactcagttcattcagatctacaaaaagccctcactgaggccgggcacggtggctcatgcctctaatcccagcactttgggaggccaaggcaggaggatcacttgagcccaggagtttgagaccagcttggccaacatggcaaaacccagtctctgctaaaaatacaaaaattagccaggagtggtgccttgagcccaggagtttgagaccagcctggccaatctggcaaaacccagtctctgctaaaaatacaaaaattagccaggagtggtggtacatgcctgtaatcccagctacttgggaggctgaggcacgaaaattgcttcaatccaggaggcggaggttgcagtgagtcaagatcacgccactgccctccagcctggacaacagagtgagactctgagtctggggaagagaaaaaaaaaaaaaaaaagccctcactgacatcccaagttcatagttcatagtgttttcaaagcaccattggcaataaaacataatggctataaatacaaaaccacaagtgaccctgaaaaataaactgtgcctcagttatggagtttgcagggtcatgataattaaatgacctcataaatagtgcttagtgtctgacatacagtaagtgctatatttaaactatcttagtttacgtgttattcctttatgcttatctctattttactaatgtcatattaaaagtatctatcacccataggcataaaaagcactacatcttatttgatatcccaagtgcctagcatatattaataacgggcaatcaagaaatgtgagttaaaataactgtctttggaatggtggcagcagcagggaaggtctatgtaattagagatcccactacaccagttatcaattcacaatctggtccaaatatccttaatgagcccttactggatacaaagatctttagtttctttcacaatcctcttagcccctcttgaagtcctaccaacattctacaattctaccaacatgccttgatgttgaagttaccagttcacagcaggtcagatgggaatttagaagcaatgagtcataaagatgaaaagactgctttccaatgactgcaatgacaggaatgacacagaagaaatgcggaaaagaaacagaatatagacctaagagtctaggttatctggcaggaggtgaaagctactttctccttgcatcttgaacctgacttagcatgtaaatagggaaaaaatagacctgatttgatgatggaggactagggggaatgacatatgacatactttaggtcagcataactaattttggtgaaaatattttttcttttatttacttcgagtaatataaaaatattcaattaaggggggaaattgaaattcccttccatgctgagttacagggttccagacatgattgatgttactgatattagtactgtgtggaaatacctagagatttgattatatatcctcaggtacttaatttctaaattgatagcaacatttattattttgttcctttaatgactcaacaaaaatactgcttccgtctttcttttgaaaactggcaaaagtatgaacattaagaaattttacttgtttgcttcttttaaaatatagccaaagaaaagagacatttattctttttaaacaagtaaaagtaaatcaaatataatttgaagtacttctgttttatttagcatttgtaacataccaactggcacttgtacaacagaattaacctttaaagtaaaaataattcattgaatcataaagtaccagcagccaaaagttaaaagtgaatgactaacttttacagataaatgttctggccaagaaaatttaagttaatttaagaaacaactgataaagcattcctcacacttcaaaggaaaaatttacttgttgaaaatcttcaatatgtgaaaaatctcctaaaagtactacaaaatagtgtgataaccttaaggactaaagaaaaaccaagattcagaactattatcagaaaatgaaagacttgaaaatacacccattttaaaatatgcagtttgtttctctttttaagaggctcgtgttatgaaaaaaataaaagtttgggtttctttcttacatgggtattgttattatgtaaatatctgtaatttatttttttatattcagacctctattcacaaggatttcagacagcctgtaacaatgtttaattaaatatagaccgacttacatcaaaatagcataaagagaaaaaaaactgataaacgtaagagtcaatatatatttttatgactaataaattttgattctactgccctgacaaggcagcaaaagggaagggaggaagggagaggggaaggaagaaagggagaggaaggaagaccagacattaggaattcacattaacagaagagatagaatgccaaatcttcaaggaaggcaaggttatcagatgacaatttcaaaatgaaagatattaaatgacaaatgatttatgatattttgaaatgttaaaaaagatatgttttccagttacatggagacatactctggtattccatagatctcttaaatattatgttgtaatataacattcttaaggctactactgtacacatgttgattactcatgcaaaatattacttatcaaaacacttcttacaaaaaaaacaaaatttaattccatattttctaaaattatctactctactgaaatacaaacagcaaaaaacaaggtatcctgaactctccacactttgaatgattattctaaagttgatccagaattttcactctagataaatgtacatttaagctcctaataactcacagataggccagttgcttaaatgacataattaaaaactttacgtaaaacttccaattctggccatgaaataataacaaggacatctcctgtccttccccagaaatcaactagaaagtggcatagtgtcattgcaggactgtgatgccagagagaaggaaaataagcaatgagagtcctactatacctgaaaacaattactgtacagcaaacacaggcaagagaaatccaaagagtctgacagtctcgatgactttaggagatgaagatgcctgtggaagctgacatggttaggaattgtgggagagctatgcaaagaaagaatttcagagacctaaacaagtttccacccagaccatgctgagattaggtggcttagattataggtagatactctgtaaatacaggccaaagatgattactgagatttaaattgaacaactcccagggctcacacaagacaataaaactcagtcttcaaccaggcagagtagacagtcatcaatcatcactttggacattcaatagaggtcccaaaggatcacatctcaggagcagagtttaaccccaagcaaaggttcttctagatcagggtttctcaaccttaacacttcctcaaggttttctgacatcttgagctaaaacattctttgttgtggtgagctgttctggcttctatctactagaagccagcagcaccactccaggtgtgacaatcaaaaatggctcccgacgttgccaaacatcctctgggaagcaaaattaccccccagttgaaaaccactattttagacccattctagcaaaattttttaaagtcttgagaaaatgaaactgctctacaagtaacataaccacctgtcagcctcaaacttctgggttcgagtgatcctcctgcctcagctttccaaatagctgggactataggtatgcacctacatgcccagctaatgttactaatttttgaagagacaagatcttactttgttgcccaggttcatctcaagctcctggcttcaagtaatgctcccatgctggcctcccaaagtgcttcagaaccctcccaaagtgcttctaaaagggtaaaataaaaaatcaagacactcaacatggtaacattgaaaaggtccagcatccaatcagaaattactacacatatcaaatattaagatccataaagagaaaagtcagccagtggacaagacccaaaactgaaatactcaaatgtataagacctatacactgacaacttcaaaacaatgcagagacaaattaaagagctaaataaggctgggcacagtggctcatgcctgtagtcccagcactctgggaggccgaggcaggcagatcacctgaggtcaggagttcgagaccagcctggccaacatggtgaaaccctgtctctactaaaaatacaaaaaaattagctgggcacatgcctgtaatctcagctacttgggaggctgaagctgtagtgacagtcacttgaacccgggaggcggacagtgcagtgagccaagatcatgccactgcactccagtctgggtgacagaatgagattccatgttaaaaaaaataaaaataaaaataaataatgagctaaacaagtgaagacatatatatggtattcatggatcagaagattcaatactattaagatgtcaatttttcctgaattgatctacaaattcaactcaattccattcaaaaccacagcaggttttttttttttttgtgtgtgtgtgtgtgtgtgtgtgtgtgtgtgtgtgtgtgtggtggcgggcgcctgtagtcccagctacttgggaggctgaggcaggagaatggcgtgaacctgggaggtggagcttacagtgatccgagatggcgccactgcactccagcctgggcaacagagcgaggactacatatcagaaaaaaaaaacaagaacaaagttgaaggacttatactaccttatttcaagacttacaataagcttcactatagctaactataagccttcactataagctacaataattaagtcagttgggtattggcatcataagagaaaaccgatcaaatagattccagaagtaaacccacatatagttagttggtaaggaattcaggaaagaaaggacagtcatttgaacaaatagtgctgagaaaataattgtatacccataaaaaaaaaagttcattccttaccttgtgctagatacaaaaatcaactcaaaattaatcaaagatataaaacctaaaacatatgtaataattctaaaagaaagcataggaaacactctttgtattccaagttaggcaaagatttcttagataaaatatcaaaagcatgatccataaaagaaaaactaagaaactgaacctcatcaaaattaagtttttctgctcttcaaaaagctaaatgatcatctcaatagagacaaaagatttggcaaaatacaataatcattcatgatcaaaactttcaacaaactaagaatacatggaacttcctcaactttataaaggcatctacaaaatacaaatgtactagagctaatcttgtatttaatggtgaaagatcgaatgcttccctctaaatcatgaagaaggctctcaccacatccatccaacattatactaaggcttctagccagggcaattaggcaatttaaaaaaattaaaggtatccagagtgaatagaaagaaataaaactgtctttattcacagataagatgatcttaaaactgtttttattcacagataacaagattttatagatagaaaatcctaagggatctaccagaaaacaaaacaaaacaaaaaaaactaccagaactagtaagttcagcaaggccaccaaatagacgatcaatacacaaaaatcaattgtatttctatatactaacaatgagcaatccaaaaacttttaaaattttcattcacaatggcattgaaaagaatacttaagaataagtgtttttttaaaaaaaaacctagacttgctctctaaaaattacaaaagatgctcataatcatcagtcactagggaaatgcaaattaaaacccactaagataccattgcacatctatcagaatgccctctcccccccaaaaaaaaaaaaaaaactgaacataatagatgttgaagatgtggaacaactggaatgtccataggaatgttatttgtaataactagaaacaaccccattgtccaccaacaggtgaatggataaacaaattgtggtatgtccacacaatgtaatactactcagaaataaaatgaataaactacagtaagccttcacttaacttggtcaacaggttcttggaaactgactttaatgaaacagcattacaagttccatgccatttcactaaatgctgatgagaaaaaataactgggtttgttataagtcagtttgcttaaagtcacagtttccgaaaacctatctatgatgccaagtgaggaactgctgtactactacataaacaacatggctcagccgggcgcggtggctcgcacctgtaattctagcactttcggagaccaaggcaggcagatcacttgaggccattctaccataaagacacatacatgtgtatgttcactgctgcactattcacaatagcaaagacatggaatcaacctaaatgcctatcaatgggagactgattaaggaaaatgtggtacatacacaccaatgaatactatgcagccataaaaatgcatgagatcatatcctttgcggcaacatggatggagctggaggccattatcctatgcaaactaatccagaaacagaaaaccaaatacacatattctcacttataagtgggagctaaacaatgagaacacatggacccaaagaggggaataacagacaccagggattactcgacggcagagagtgggaggaggaccacaaaaattacctatcgggtactaggcttattacctgggtgacaaaataatctgtacaccaaacccccatgacacagtttacctacataacaaacctgcacacgtaccgctgaagctaaataaaagttttttagaaaaacagcatgcccacttaaataaatctaccctagagacatacctgcacatttatgaaatagcataagcccattattctttgtacataatttatattaacaataatatccatcaagagactaggttaacaaatacacaacgaagcatttgctacctataaaaaagaacgagaaaatctcacgtatagatagatagggaataatcctcatacctactattctatgcacataagacgtatttttaagttataaaaacagggtgcaaaacagtgtctataatataccaccttttatgcaggatggggagaggataagaatctacatacttagttgcttacatttgcaaaaataaaataaaaatagaaaaaaatagccagaaaataaaaatgactaccaataaggaaaacatcttaaaggtaactggatgggagagaggcatctctgagctacatttttatgaagaaaaaacaattcccaatagtgaaaacaaacaaaaaaaaatctaactgtatgctgaatgggtaacggtagctttaaggcacagtattttgactgtatatccttagtgagattagtctatctcaaaaagaactgccaggaaatcttgaacttttcattagaattgttcatagcaatgttaatattgctgttctgaaactatcttatgtatgtttaaggtcaaagctaataagcaattatgctgatattgctaggaacgaagactttctacaagcgcaaggataagaaatacaaatttaaaataagaaaaatagcaataaactcacgatctttaaaaatacgtatttcctaattgttcctgaaagaaaagaatgatatcacagtagctataaccacctctaatggcctggttttggtcttaatatacgttccactattagaagtaaccagaacctttggaaaaataggcctgttccaggctatttataacataagcctgggacatattgagtcaaaaagaaaaaagattttgaacacgaatgagacaatgaaaccggcttaaaagaaccaaaatcttaaaaaatactattccctatatcccaaagaaaacattgattcttaccatatctataccaaaaaggctgctgtcatcccagatatctgttgaaattgcttcaccaataagtgtcatatcctctgtaagcaattccagaactcttattatcacttgtctgctacctaggaatacaaacagaaaaaagtaaaggagaagaagttacttaactttaaaataatcagctgaatatcatattgctcaattttctagttagtcatgctccaacattttctctttttttctaatgttcttagaactgtagagaaatcacaatttacaatcacactgaaggcttctgttccagtcacagtactactttactacataacaaatcaaatacatttataattggaaaagatattgaaagtagcaataatctaacaagtactgtgagatagattaaaataatttttcgaatttagggaccatccattttacacgtaatatgtgacaaagcaccagaaaggtttagaaaacgtattccaataatttctacttagtactagaaggcgtgagccttctcataaattagtattttcccacacaggagttgcctgggaagctaagcttggactggagcaactaaaggaataaatgaacatgctaacatttgctaaagaaactatttgtactcaccttaaactcaaaaaaacttcccaaagtcacacccaccagagcaacctcctttctccacagagacagaataacaaagactccacttccattatcctgtgtgagacgaacattcacacgagactttcccaccccgcatcccaaaggttaagttctaatgaatcaaagtaaaacaaactaccagattggaaggatctagattaattttttcactagaagagctggaccaaattctcttacaaatctcttacgatattgaacagttacaaatcatgccataatttaccacaaaagggcaggagaacatttagtttttatgtaccaagatatagctttataattatcaatctgactttttaaagcaaattaaggaaaggttaaatgcaaaatcattaaagtctaagactgttcttctcagcttaccagacagataaacatatgtactttatgatgccaaagttcagatctttcttcatttcacattattagtatatgaattaatatatagttccagctagtagaagcacttactgagtaaaaagtatgagtacacagttttcctcaggataaaaacattttaaatgttttccaaatatataccttcctgcttctttctcctccatcacctccaagtggcaaaaaatagacatgggacttaaagaaccattaacttggaatatatatttttactttgccagtataaagtaaaaagggcaaaacttggttatcttatttatatcctgatgagtttatcaaacgttgaaaatgtatagattttgagaataaaaatcatgactgttttctttctaaaactttctttacaccttgcaaaatgctaaagtatttaaaagcatggactttagattcaaaagaatcgtggttcaagtccctgcttttagccgtttgacttcaggcaagtttctaaaccactcaaaaactcagcttcatcatttgtaaaaatggagataaaattagttaactaccagtgaaaaaacaaaatgggttgatatgaaaaatacacgaaataatgcacacaaaaccaagtatgaaggcagaacccagtagggacacgtgctaactgttgtttcattactagactcagcagacctctgtcatattgttattgctgttaccattgttcagtacaattacaattaaataccagtgtatatttcagtcaacctcttcaaattttcctagtacatctgaacaaaaatgggatctcaaaatatttgtggcttttttaagaaaaattactacaaaggtaagaatccagttttggagttttgtttttaacatgttaagtggcttaagtagcaagaaatgaatgggaagagtaaacaactgacagctaatcaaaaagtttccaaagagcaaaagccaaagatttttttattctggtctattcatgccagtccaccttttataccttattccagttgctgaatgttgtcactgctcaaatttaaaatagccatacagtccaaaaaaaaaagaaaaaaatagatgacagcaagaataaatgcaaaaaatagataaaaattctaaaaaaaaaataagcatgaaagcctgtgccaataaaaactcataaaatggaagggcaagctgaatagccctccaaggcatccacatttaatttaaaaataataaagaccttattaggtttttagaaatttatatcccaaaagataagtaaatacagattccaaaggccctaacatagaagagaaaaaaaggaaaatcctaacgaaatacaaaacagacacaaattatatcagaattacgatttctaaaacaactaacctgttcttaagagaggaacagctgattccagaatggagacacaaaactggggaagactgagctgctggaattgtagttccaatgtgtcttcagtttccagctctggcagatctatgtgtcccatatccaaaggtgaatgaacggatatcctggagtttacatgagcatgactactacttccactgcaagataaacaaatgataaaccttgcatacagaaacaatccccaaacagatttactgcatatctgctgcctcgcatattagaagcctcatacaagtcacaactctactgcttcattcaactctggtcagatttgtagaaactttgacaaatttacgaaattaaattccataaagatgactcaaggccaggagtggtggctcatgcctgtcatcccagcactttgggaggccaaggcgggcagatcacctgaggtcaggagttcaagaccagcctggccaacatggtgaaatcccacctctactaaaaatacaaaaaaaaaaattcgctgggcatggtggcacacacctgtaatcccagctactggggaggctgaggcgggagaatcttctgagcccaggaggtagacgttgcagtgagctgagatagcgacactgcactccagcctgggcgacagagcaagactccatctcaaaaaaaaaaaaagactctaaattgtaaatgaagccaaaaatgcatctatattttgcttgtcaggctgatatctcaaaacatgtcaacattcctatagtaggaatcaatattagcactgataacccattcatttccaaaaggaaataagcagatttataggaaagctcttctgtaatcaacgtgtagagacaaaaccaatagttcataccgtttcctagattttctgagtttcaccactgttctgagtaagccagtgttagtaaatgaaggatgtttctagaaaaacctcatgggaaatgtattacttcacttagtacattcgacatcatgtagtgacttcaaaaatgcacccaaaaaaacggaacatcccattgtccttggctttcttcattaaaaagttcttacctcggatgtaaagtgctggagtaaggatttaaaaagtgtagaaaggctagagcctcacacttacaaagagcctcaaaattttgtcttttgatgttatccacaaccgaagctggatcacaagagacatattaatgctatggaacatttaaatttgcccaaattataaaccaactttgtcgtttcttcaatttcaagataccaagcaccccaaaatatggaaacaactcgggcttctctgtaactctgaaaggaagtttcagtgaggaagctgttcactcaggagtgaaaacttagaagcatgaagcacacaagagaatgaggcagaaaggcttcaggagaaagagaaaaacatggctgaacaaccaactacaatataaggactaagagcatagactctcctatcattttatttaaccctagctctgctctttaccaactgttatgctcttaacctctctaaacctcaatgaggatgataataataatactaatgctatatataatatcaatcctattctaggacaactaaaggagacaaagtatgcaaagcacagggcataacaccatacacacagcaggtatgaatcagtattagcttgttaacagtagtagcagtattgcaagaaaataattaagccaacagaccaatgcttaacttagtgaacattttttagaatgacactaaagagactaatatgtttctaacacatttgcacccaaggataaggtaacatacaaataccacaccaatccttttaagcagagttggtgtatgaaaatctgggtgccaagcactgggggccaagcatggtgactcatgtctgtaatctcagcactttacgaggccaagatgggaagatcacttgagcccaggagttcgagaccagcctgggaaacatagtgagaccccatctctacaaaaaataaaaggcttagccaagtatggtagtgcacatctgtggtcccagccactcaggaggctgaggcgaaaggatcacttgagcccagaagtcaaggctataatcgtgccactgcactccagcctaggcaagagagtgagaccttgtctcaaaaaaaaaaaaaaaaaaaagaaaaaaatctgtatttacacaaacaaataccataaattgttcaccttgaaggagtccttattttataaaattctccaaccattccttttaacagtaaacacttatccatttgttataagacttacaaaaatatgtgtaaaatactatcaacaatgtatctatcatttaaagctattcttttaaacttgatcatattccgtttgcagctggtaaaaacaatttattgggtcagaatcatttcttttctaatgaaatcggaactgaaaatatagttcagtgtgtcaaacatagtatcagaatactattatgtgaacattttgttttgggggacacatacacacacatatatatacataaacagagcatatgttcaagtactgagcactgagttgcgatgtaatatttatctgtccttaccgtggatcatggtcaaaaaaagtatgaagccagggtttaacacaaggcctatacctgtgttaatgtttcaaaaaaaaaaaaaaaaaaaaggacagaaaaataattatctccttctgaaattaacacacacacaagttaaccggcatttctcatttccccagagacactgctagcagtcacctagaggacgctgcatcccagtcctggccatctcctctgggtcgctggcctgtgcgcccaaccacagaaggccgagggctgctgcttcctggggaaggattctgggaatgatgagtacctcttgcttcatgacaataagacaaagaagaattttgggaaactgtgtctggggaaacaaagaaaaaataaaattattctttagtagaaacagacttctgactatgtggtatttatgtatcattcttccaaaaacattaacaaattaagatagtaggaatccttctacaggggtaaaaacaaaagcaaagatcaaacttttctataagtattcacttagtacatttaggtttatatctaactgacttgattacatgggaccttctagtcaatggcattcagttacaacattagagactaccaaagcagaaaaacactagatcatgcactcgtctgcttaaaactctccaagaatggctacctcatactgtacataaaaattaattcaaagtggatcaacaacctaaatataaaagctaaagccataaagctcttagcggaaaaaataaatcttcatgaccttgaatttggcaatcgattgttaactatgacatcgaaagcacaaacaaccaaggaacagacagataagctggacttcatcaaaatctaaaactttggtacaccaagggaacattacaagaaagtgttaagataacttatagagtgggaggaaatattggcaaaccatatatctgataagggtttaattttcagaatatataagtaacctaaaacccagcaataaagaaaccagtccaatttttaaaatgggcaaagaactttaataaacatttctccaaagaagatacatgaacaaacaataagcacataaaaagttattagagattcattggtcattaattattaggtctttagagaaatgcaaatcaaaaccatgagataccacttcacatctactaggatgactacgattatttttaaaaaagaaaaaaatgaacaagtcagtgatgatgtggaaaaactggaagctttatatattgctgatagaaatgtaaatggtacagctgctgtggaaaatagtttggtgattcttcaaaaagctaaagatagaatttccatatgacgcagcaatttcactattattcactgggtattacccaaaagaattgaaaccaggcactgcacagatacttgcatgccaatgttcactgaagcattattcacaaccgccaaatgtgggtacaacccacatgtccatcgacaaatgcatagatgaataaaatgtgggatatacatgcaaaggaatattattcagccatataaaggaatgaagttctgatacaagctacaatgtggatgaagcttgaaaacattacaaataaaccagacacaaaaggacaaatactgtatgattcctcttagatgaggtacctagaatagacaaaatcagagacagaaagtaaattagagtttaccagctttggggaaaggaaaaatgaggaatcactgcttaatgattagagtttctgtttcagataatgaagaggtttagaaacagatagtggtgatggctgcacaacaatgtgaatgttattaatgtcactatattgtatacttaaaaatgtttataatggcatattttatattatacctattttaccccaatttaaaaaaagaattaggtaataaaagcatttacagtcagagagagggggaaaaaaaactctccaagagcttctcactacacttcaaagaaaatataaaatctttaaaaagatctgcaagccccaatatactctggcccctaactacctctctgatgtcacctcattctcctcttctgcccagctcactgcagtccactctcatgggctttatttcagttgctcaaggacatcaccctcagtgctaaccttgaggcctggccttccctggaacactcttcttgcagctcttcgagtgacgattccttgtcacccttcaggtcacctcctctgagggactttctctgactatcctaaatgaagctatgtttacccaaccacgttgtgtcacatcaccctttttatttccttcaagtacttctccttatctcaagcaaacttgattgtttatcacctgtccccagccttttaaaatagaagctttctgagggactttccctgactatcctaaatgaagctatgtttacccaaccacattctgtcacatcaccctttttatttccttcaagtacttctccttatctcaagcaaacttgattgtttatcacctgtgcccagccttttaaaatagaagctcataagggcttggatcttattcgtttgttcagtgttatacttccctagaggctagaatatcaggggcataaaacaggtaataaatacatacttattaaatacattaacaattcttcagagatatcaactttttaaatcaacattgtaactctttttctgttgaagtatggggtacccagacgttctctattaccagtcatttgtacaatgccataccctctaagatctagaataaaaccaaggtaaagcataaatattcaagtagcacaggatcagtgaaactcccaatgaaatagggattaactatgaaacatgatgacaaatgactataatatttgactttcgatgcaggttgcattaagctcacaaaaatcctaaatggtactggttttgtcgaagccaggctggtactctatttggccattaggtggcactttttctctgaagtctcacattgctgcaacacttgactacattgcaagttgcataaaaatactcttcataaaattcaaatcaatatttttcaaacaaaacaatgtattaacactatatgtaacttgctaaattgtccaaagtcctacatgaatagccataccaaatatccgagtcactacatcccaacaacactatatagaatctctgcaagtttgggagaaaaaagaaaaacaccttgtaaatatctcttatccagaaaaaaaaaaaaaggctcaagagatcatggcagtttctgtcattcacgcaatctgtaaagataatcatttgaatacatttaggagtggggagtttatgttgtgaaaatgcgtacacaataaaccctaacagtaactataatggaaggttcccagaagaatctacaaataacaccagtggctaatgaacagataaaaataaataccgtgtttattggagaaaaaacctggatctcggtgaaagttaagtctgtttcttaaatacatgcacagctgctgcaggcaggacaccgactgtaatgccaggcgatgctttccatctccaaaggccagtttcaacagagataaaaggctctgaaatcaagaagagccgtgaaaattactaagggaacaaagagctcaacttcaaagcagaatgtggagcttaagtaagtaagcctaagtgaataatcaagagaaaataagttgccaaatatttgtaagacataagaaactgaaatgggcaaatatgacttggcataaagcaaggagatgggtcaaaataaaataagacaacaacatttaaatagaatagtcagtgtttcctatttctaaaatctgttagttgagtaaccattctgagagaagacagaaattattccccactcaggacattacattacagagaacattttaaaaatcacagcaagcccttttcatctcaagcatctaaaccatttaaccacattttagtaattaacagctttcctctgcgatcatttgccagctttgatcctaggtattaacagttggcacccactggagtccatttcagccctgggagtgtggagcgagaatgctgagccattactggctgctgtgaagatgttgcaattccccaccctggatccctctctctctactatacaagcaataaactagaaaaaaagaaaagaatccatctgcgttactcaccgctactgtattttcccagcatgtagcactgtgcgttaaataaacgagatactcaagaagcaatgctattcttacttttaataagggctcctgcacaatctcaatgtccaaagtctactctaccatttaggtgatccataaatggtaactcaaggtggccagactggactgcaagtgtcaaatgaaactactactattggaagaactataactatccacccaagttagcgaataagtgctttaaatagccaaatacttcactttttaaaaacatgagtacaaagttccttcccaagaactcctactctgcaaaatttgctttattgcaaaaagttctctagttcaaaatctaaaacaattatagagggcactgacctgaacaatttttggcctttgaaggaaaatctcagcaggaaaatcttgcatgataacatccttcaatagttcacaggtgttccagattaaagtgtggttactacttcttaaagagctacaaaacatagcgttaatcatttttaagaagagttcatctattccagattctaagtagcctactgacacaatgactccattaacaatcttttgggtctcagctgagatatcacttctccagaaaagccttcctagatcttttccctaaccaataaacaactctagggcagtgctccttccgtttgtccattatttgtgatattgttaactgcctgttgattttgcattccccactagaccctctcaagagcaggaacgacatcatactaaacactgtaccctcagagattatcacaagtctgcaaaacgagttcaatgaggtcaaagagcacacaattctaggaaatctgccaaataaattaagaaatgagacagaacaaaagtacagaggcaaattctaagaattaaagtccttactgatcttccccactcaaggtgaatcagattaggactcccctcttatcccatacagaggacacctatcaacttctgcccacctaggattggcagttgttcactccccaccccaaaaaaatcacaccccttctctcagcccagttccattatactatccaccattcactatctacaggcatgcattagaaattatcgccatctctgcctttgggactgactcaaaactgagagatcatacaacctcctaaccctttcccatgtgcactttgcctctcgaatatgttgttccaagagaattcatgtcattattaaaaatcacttaatggcatccacctgtaatctggacttagccctagtaaattggtctttattttccagatttataccccaaaaaagcagataactcgtgtattgtggcatttatgaaactgcacaaagtgaatctggacattaaaatactctctaaatctctatatatcagctatttactcttgtgggtagcaatcaattaacagtcattacattagattggatcagtggtacccaaccttatccacatggtttaatttgtctcctaatgaagcccacattttgaaatatattctgccaaaaagactacatttatgttcaattttccatttttatcaatcaagggcataagcaatggccaataagagaatctggccaataagagaaaactcctgtcaccaaggactacacaagagtccaaccacaaaaagaaacgtgggccaaatgcagtggctcacacctggaatctcagcactttgagaggccaagaggggcggatcacttgagattaagagttgaagaccagcttggccaacgtggggaaaccccatctctactaaaaatacaaaaattagctcagcgtggtggtgcgtgcctgtaattccagctactcaggaggctgtggcacaagaatcgcttgaacccaggaggcggaggttgcattgagccagatggtgccattgcactccagcccgggtgacagagtgagactctgtctcaaaaataaataaataaataaataaaagaaacttgatgtgtagattgattaaaagcaaataggaatttttttctggctagctttttgaaaaataaaaatcatttaaatatgaccattactacctttcactgccactagtatcttttcctggtaaaacatattgtaataactatcaaacttaatgactataagtgaacaaaaatacctgaaaatacatcaagcaccgtacctttcattagaggagaggacatgtctgtctgtggtggtcaggggtagccaaggaaatgtagaaaacttcaagcacttcacagtctgatttactgtcagtgaaagagcaaatcttatggtatcaaagaataaagagatgacagattcacaatgttaagagtaagttttccctttaaaacaagtcccaaaataaaggctgcatcttacagtaacctaaaatataccaaacaaggtcagctgcaaatttgttctatcacaggataaataagagagttctcttttcataatttaaacagaactcatatgatatcaaaataagtattagaagaagagcattaaacacaatccaatacagactgacatatgaagtttccattaaattttctattttaccctgtggctgaccagaacatcaaacttaaattcaacataaaaggaactgacatttagggaaaaccttaacttttcaaaattaaaaatgataaaacataatgatataccatatctagccatgttcaaatatcctatatggtgtcaggtgttttaaacctctgcgaagatgacttgaagaccgtaaggtcaaaaaacaagtatcagtgttcgaacaagattaaaagaaatctgagaaagcaacagttttaaactatccccatgcaagttatttttaacagatcttatatagtacaagttaaggtggcaacactgagaaatagcatctacataagtccttccaaatggcagtctttctgccaagtgctttgaaaagagcatggaatcgctaaatgtggatagcagtattattaaattcccaaacatagcacagttacttctttcaaaattgctaacataaaagcaggatttactttctaaggaaataaggagaggtgggtggagggaaggacaggcttacaccacacagtaaaaatgtgtccaaaataagccagaccctcaatcaagacaaactgcaactcacataaaagtgtaacaatctcaatcccccttaatgttttcatcggcttcattcagacacccatcctttaccaaccctagagattccccctcccttcagatgtctctcatcttgatggaattaagcctctcagccatctggcctcaaaaacaaagcttgctacaagcctaacaatgaatgaaaaggtaaagtattctaatggcttaacaagttttcagttctttcttgttattccacctgtgagtttccatgaaagctttttaataacagaggcttccaaatggagttcatttgaatatgtgacatcagcagatatactcttgaacatatccttttcaacttaactgtgcaggcaagaaaatggtaagtacgtgattacttaactacttcctaactgcctcaccaaggacaaagttttcaacctttctaatctcagtgtctttattagtaaaatgtggtcactaataataccaatctcaaagacactccaggaggattcattcattccttcaaagaatatatactgagtgcctaatacattttttggtattgttccagacactgaaaataatgcaatgttcacggctattatcaaacttaaaacaaaaataataaaaaataatgtgttaggaagaaaactacacataggaagtgatcactggctagaatcaccaggaaggtctctgatgaggtggcatgtgagctgaggctgaacacagccagatacaaaaagatggagatgagattccagattccagaaacagggttctaaatcagaactttttaattaactgggtggtgaggaaatgggaaaagaaactaaaatgatcttcagcctctggctggcgtaactggatagatggtgccatcgttaagctggagaacaaatgagatgacatgtgtagtgcagggcacaatgcctcaaaaaactcatgttcggccgggcgcggtggctcacgcctgtaatcccagcactttgggaggccgaggcgggcggatcacgaggtcaggagatcgagaccatcccggctaaaaaaaaaacggtgaaaccccgtctctactaaaaatacaaaaaattagctgggcgtagtggcgggcgcctgtagtcccagctacttgggaggctgaggcaggagaatggcgtgaacccgggaggcggagcttgcagtgagccgagatcccaccactgcactccagcctgggcgacagagcgagactccatctcaaaaaaaaaaaaaaaaaaaaaaaaaaactcatgttcattcagtacgacatactactgccattaataccatccatctacacagttgttcaaatatggttagaataacacaaaattttatcatttctactcgatatcctaaactaacttgaaacaactaaaacatttaatgatagtttggtgctgaaacattcaagtttggtaaaaatacatcttcacaataacgaaaaaagtacattaattttcaacttcccaagtcaacaggatttacttcccgacatatacacacccactggtcgtggcggcacttccatctgctggaaattacttttgtcttggggaaaatatcctgttaagatttcagggttttttgacaattctgaaaaggaaataaacattactgtattgtcgattccttatttgctaaaagtgaaacttactttctttaagtggtaatgttttctcttaagtattggaatcattttaaaaattaaaaaaaagtccagttttttttctgaatgatctatcttgctaaagaggaaaaaatgtgcacattgagcccacttccagttaagaagctttttccctctcacttttactgttagccaaacacagttatttgttagaatgtacacgaagaatctgctacaaagtattcaaggactatccctctctacttcctaatccatctccctctcccttgactccaattatatagttcctgatcacttcaattttcattcataccttaaaaagaaagttgtcaaaaacaaaggagtcaaatattatctttcaatacctttacaattccctataacatgcgattatatgttcagcagttcagctgcaatgaaaatgaggaaaaggctaaaactatagtttgtaattttaagttttcatggcaatagttcctaacactaataaagaaaaataacatttagccctaaaccattcctctactttcacccgcaaggaatcagattaaaaattcacagtgtaagactctactttatttgtgatgtcttcgaaactgtaaaatatattgttaaaaatcacaggtttgggagccagataaagcaatgttagaatcctgcatctgctacaggttagaaaacttggtactgtggggcaagttactttatacttttattctcagctatagagtaagactaataacatctcagtcaaaaggctgctttaagatttaacaagatgatgtgtttaaatcaatgtattcaatgcccacaacaaaactcaataaatgacagctgctattgttgttgtgaaccgcagtacccacagctgaagctgtaacagtactggcagagaagaaaatatggtctaacaggttaagcatcaaaactttttttttttttttttacttttactactcagtcacataaattgcatgaagatgtttttcttcaaatcaattcaaatgcattccatgtgcaaggcactatactaggcattaacaacaacacaacagcagcagcacagcagccaacacagccacatttcatacatgctgggccctgtgctaagcactttacagacattgtctcatctaatctcatgacgattctatgagaaagtgttcttttttttttttcgagatggagtcttgctctgtcacccaggctggagtgcaatggagtgatctcagctcaccgttgcaacctccgccccccgggttcaagtgattctcctgcctcagcctccctactagctgggattacaggcgcccgccactatgtccggctaatttttgtattgtatttttagtagtgacggggcaccatgttggtcaggctggtcttgaacttctgaccacctgcctcggcttcccaaagtgccgggattacaggcgtgagccaccatgcccagcccggtgttctttcttattatcccagtttttgaatgagaaaactgaagcctggaagggttaattaccttagccaaggtcacacaactagcagcagaactgagacttaaatccatgtctctttgacttggattttaacaagtatatcatgatggactgcagcatataaaaatacttgcattatgtcgttttgattggtccccacaacaagatcatgagctaggacagatatcattatactccaatatgacgaacaaggtcaaaaatacaaatataaagcactaagaacaatgagcactcatgtgctcaataaaaatacattgttattgccaaaaaaataatctgtcaaactggcctcataaaagcaaagtcactggcatcgtttaggcctgacccaaaaagcaattaatgcaaatgtaccatcctttgactaacagtagaggaggggaaaaaggtcaaaatcatgtaagttaacacaagaaaaataagtttgggggaggtgggagaaatcctttttaaaaaaatctaatctccctttccttaaaatttaccattagaattaatatatttgtatttaacagattccaaagagttaccagtttgattggtttggtatgaggcagaagatagtgcaggaacttccgaaggaagaagaaaaagtccatccagaatgccatcaatttcagcctgcagatttggctccacattagaccgaagcttagataagaactctactgcaccaacgtcaaccaaatgttggactgctgggggatactaaaataagaagaggatgatcttgagaataactgtatcaaaatctctataacttacagcaatcaaaacataaaattatttttggtatatcagatgttccttttctgaaaaacaaatccttcatggctctgccccgaagtaaggcacttccatgaggagcacatacacctatagagacatacatccaacacttgataacatttatgaaagatgagccaacacactgaacgctagaaatgcacattatcaatccctactcttatttttttaatgggttacttttttccactgacactcaccttatggtcccagccccaaccggtcaacaggatgtcaaagtagtttaagattcctctaccattgtacagtgatttagttttgaaaggttaaacttacactttgatatctgaccccgataactaactactcttgaggtaggcataagaataccaatctaaaagcatatgggcaagcaacttaacattggtatttatgaatcacggttatgtaacattatttttaaagtgctccctttcatactgacatatctagtttttaagatgtaaatgtcagaaaacaaaaacagaatacaaatattaacctccaaagataactcaaaaacacagaacataccaaaactcaaaagaagttctgtgttacttctgagcacagcagagaccatgtgggattcagtatcacaaataaaagatgaaccatatacccagattaattaaaattaaacatctctggttgattaaaaaaacttttaaccccaattatttaactttcaataaacgctacaattaaatgactaagaaacaagtcactcgtctgattattttctttatttcaaaatgaccctaccttaaccaatctgcttaacaggttcagaacctcttccttcatcggaacggacgggaaattgaaccattccagcaaatgaagaaaaagttgcctctcctgaatgagatcagcgtagcagattaagttgtgctcaatcttgcagagaatactcttgagagcgcgctccctgatctcggccagctgatgacctgtcaacgaacggcacaaaactattttatttcccgactgcaaagagactacgttatttatgctgtgggcaggagcggcgtgaagacggaataaaccagtttttttcagaagcaggccactggtgccttcgggacgcgaaccgcgaagtttacacaaagtccgagatgggtccccgggggctatcctgacaaagcgggggtgaaagagggagcggtcgcggagcggccggccgcggaaacgtgacacgaccattctcagcaagtggccagagcgcggggggtgccttgggcgaggggcaagctgacagttaccgagtttcctgatgagccctgccaggaccatctcgtcccgtcaatctgcagccgccggagaattaaactgccgcgccactgcgtccagccacaattaat
